(12) United States Patent
McCoy et al.

(10) Patent No.: US 12,116,384 B2
(45) Date of Patent: Oct. 15, 2024

(54) VIRUS VECTORS FOR TARGETING OPHTHALMIC TISSUES

(71) Applicant: Ginkgo Bioworks, Inc., Boston, MA (US)

(72) Inventors: Daniel McCoy, Durham, NC (US); Garrett E. Berry, Durham, NC (US)

(73) Assignee: Ginkgo Bioworks, Inc., Boston, MA (US)

( * ) Notice: Subject to any disclaimer, the term of this patent is extended or adjusted under 35 U.S.C. 154(b) by 725 days.

(21) Appl. No.: 17/045,087

(22) PCT Filed: Apr. 3, 2019

(86) PCT No.: PCT/US2019/025584
§ 371 (c)(1),
(2) Date: Oct. 2, 2020

(87) PCT Pub. No.: WO2019/195423
PCT Pub. Date: Oct. 10, 2019

(65) Prior Publication Data
US 2021/0371469 A1    Dec. 2, 2021

Related U.S. Application Data

(60) Provisional application No. 62/652,108, filed on Apr. 3, 2018.

(51) Int. Cl.
*C07K 14/005* (2006.01)
*C12N 9/22* (2006.01)
(Continued)

(52) U.S. Cl.
CPC .............. *C07K 14/005* (2013.01); *C12N 9/22* (2013.01); *C12N 15/11* (2013.01); *C12N 15/86* (2013.01);
(Continued)

(58) Field of Classification Search
CPC ........ C07K 14/005; C12N 9/22; C12N 15/11; C12N 15/86; C12N 2310/20;
(Continued)

(56) References Cited

U.S. PATENT DOCUMENTS 4,039,388 A    8/1977    Gal et al.
4,501,729 A    2/1985    Boucher et al.
(Continued)

FOREIGN PATENT DOCUMENTS

CN    107012171 B    7/2021
EP    1033405 A2    9/2000
(Continued)

OTHER PUBLICATIONS

Naso, et al., Adeno-Associated Virus (AAV) as a Vector for Gene Therapy, 2017, BioDrugs, vol. 31, p. 317-334 (Year: 2017).*
(Continued)

*Primary Examiner* — Evelyn Y Pyla
*Assistant Examiner* — Katherine R Small
(74) *Attorney, Agent, or Firm* — Foley Hoag LLP; Brendan T. Jones; Tracy L. Vrablik

(57) ABSTRACT

The present disclosure provides AAV capsid proteins comprising a modification in the amino acid sequence and virus vectors comprising the modified AAV capsid protein. The disclosure also provides methods of administering the virus vectors and virus capsids of the disclosure to a cell or to a subject in vivo.

21 Claims, 5 Drawing Sheets
Specification includes a Sequence Listing.

(51) Int. Cl.
  *C12N 15/11* (2006.01)
  *C12N 15/86* (2006.01)
  *A61K 48/00* (2006.01)
(52) U.S. Cl.
  CPC .......... *A61K 48/00* (2013.01); *C12N 2310/20* (2017.05); *C12N 2750/14122* (2013.01); *C12N 2750/14143* (2013.01); *C12N 2750/14145* (2013.01); *C12N 2800/80* (2013.01)
(58) Field of Classification Search
  CPC ........... C12N 2750/14122; C12N 2750/14143; C12N 2750/14145; C12N 2800/80; A61K 48/00
  See application file for complete search history.

(56) References Cited

U.S. PATENT DOCUMENTS

| | | | |
|---|---|---|---|
| 4,968,603 | A | 11/1990 | Slamon et al. |
| 5,139,941 | A | 8/1992 | Muzyczka et al. |
| 5,328,470 | A | 7/1994 | Nabel et al. |
| 5,399,346 | A | 3/1995 | Anderson et al. |
| 5,478,745 | A | 12/1995 | Samulski et al. |
| 5,658,776 | A | 8/1997 | Flotte et al. |
| 5,686,240 | A | 11/1997 | Schuchman et al. |
| 5,863,541 | A | 1/1999 | Samulski et al. |
| 5,869,248 | A | 2/1999 | Yuan et al. |
| 5,877,022 | A | 3/1999 | Stinchcomb et al. |
| 5,882,652 | A | 3/1999 | Valdes et al. |
| 5,905,040 | A | 5/1999 | Mazzara et al. |
| 5,916,563 | A | 6/1999 | Young et al. |
| 5,962,313 | A | 10/1999 | Podsakoff |
| 6,013,487 | A | 1/2000 | Mitchell |
| 6,040,183 | A | 3/2000 | Ferrari et al. |
| 6,083,702 | A | 7/2000 | Mitchell et al. |
| 6,093,570 | A | 7/2000 | Ferrari et al. |
| 6,156,303 | A | 12/2000 | Russell et al. |
| 6,180,613 | B1 | 1/2001 | Kaplitt et al. |
| 6,426,198 | B1 | 7/2002 | Carstea et al. |
| 6,468,524 | B1 | 10/2002 | Chiorini et al. |
| 6,468,798 | B1 | 10/2002 | Debs et al. |
| 6,503,888 | B1 | 1/2003 | Kaplitt et al. |
| 6,544,785 | B1 | 4/2003 | Palese et al. |
| 6,562,958 | B1 | 5/2003 | Breton et al. |
| 6,733,757 | B2 | 5/2004 | Patel et al. |
| 6,822,071 | B1 | 11/2004 | Stephens et al. |
| 6,962,815 | B2 | 11/2005 | Bartlett |
| 6,984,517 | B1 | 1/2006 | Chiorini et al. |
| 7,045,675 | B2 | 5/2006 | Carstea et al. |
| 7,071,172 | B2 | 7/2006 | McCown et al. |
| 7,105,345 | B2 | 9/2006 | Wilson et al. |
| 7,198,951 | B2 | 4/2007 | Gao et al. |
| 7,201,898 | B2 | 4/2007 | Monahan et al. |
| 7,214,786 | B2 | 5/2007 | Kovalic et al. |
| 7,252,997 | B1 | 8/2007 | Hallek et al. |
| 7,259,151 | B2 | 8/2007 | Arbetman et al. |
| 7,282,199 | B2 | 10/2007 | Gao et al. |
| 7,314,912 | B1 | 1/2008 | Hallek et al. |
| 7,473,531 | B1 | 1/2009 | Dornon |
| 7,588,772 | B2 | 9/2009 | Kay et al. |
| 7,712,893 | B2 | 5/2010 | Dobashi |
| 7,718,424 | B2 | 5/2010 | Chiorini et al. |
| 7,749,492 | B2 | 7/2010 | Bartlett et al. |
| 7,777,097 | B2 | 8/2010 | Glazebrook et al. |
| 7,790,449 | B2 | 9/2010 | Gao et al. |
| 7,867,484 | B2 | 1/2011 | Samulski et al. |
| 7,892,809 | B2 | 2/2011 | Bowles et al. |
| 7,906,111 | B2 | 3/2011 | Wilson et al. |
| 8,067,014 | B2 | 11/2011 | Kay et al. |
| 8,299,321 | B2 | 10/2012 | Cao |
| 8,318,480 | B2 | 11/2012 | Gao et al. |
| 8,343,764 | B2 | 1/2013 | Abad et al. |
| 8,445,267 | B2 | 5/2013 | Zhong et al. |
| 8,628,966 | B2 | 1/2014 | Chatterjee et al. |
| 8,664,475 | B2 | 3/2014 | Puzio et al. |
| 8,679,837 | B2 | 3/2014 | Zolotukhin et al. |
| 8,734,809 | B2 | 5/2014 | Gao et al. |
| 8,802,440 | B2 | 8/2014 | Zhong et al. |
| 8,889,641 | B2 | 11/2014 | Asokan et al. |
| 8,906,387 | B2 | 12/2014 | Kay et al. |
| 8,906,675 | B2 | 12/2014 | Gao et al. |
| 8,927,514 | B2 | 1/2015 | Chatterjee et al. |
| 8,952,217 | B2 | 2/2015 | Puzio et al. |
| 8,962,332 | B2 | 2/2015 | Gao et al. |
| 9,012,224 | B2 | 4/2015 | Bowles et al. |
| 9,066,966 | B2 | 6/2015 | Puccio et al. |
| 9,157,098 | B2 | 10/2015 | Zhong et al. |
| 9,409,953 | B2 | 8/2016 | Asokan et al. |
| 9,441,244 | B2 | 9/2016 | Schaffer et al. |
| 9,475,845 | B2 | 10/2016 | Asokan et al. |
| 9,567,376 | B2 | 2/2017 | Cronin et al. |
| 9,585,971 | B2 | 3/2017 | Deverman et al. |
| 9,587,250 | B2 | 3/2017 | Gao et al. |
| 9,598,468 | B2 | 3/2017 | Weigel-Van Aken et al. |
| 9,611,302 | B2 | 4/2017 | Srivastava et al. |
| 9,623,120 | B2 | 4/2017 | Chatterjee et al. |
| 9,677,088 | B2 | 6/2017 | Nakai et al. |
| 9,677,089 | B2 | 6/2017 | Gao et al. |
| 9,683,268 | B2 | 6/2017 | Barouch et al. |
| 9,695,220 | B2 | 7/2017 | Vandenberghe et al. |
| 9,719,070 | B2 | 8/2017 | Vandenberghe et al. |
| 9,725,485 | B2 | 8/2017 | Srivastava et al. |
| 9,737,618 | B2 | 8/2017 | Wilson et al. |
| 9,737,619 | B2 | 8/2017 | Ansell et al. |
| 9,775,918 | B2 | 10/2017 | Zhong et al. |
| 9,777,291 | B2 | 10/2017 | Chatterjee et al. |
| 9,783,825 | B2 | 10/2017 | Chatterjee et al. |
| 9,790,472 | B2 | 10/2017 | Gao et al. |
| 9,803,218 | B2 | 10/2017 | Chatterjee et al. |
| 9,834,789 | B2 | 12/2017 | Chatterjee et al. |
| 9,839,696 | B2 | 12/2017 | Chatterjee et al. |
| 9,879,275 | B2 | 1/2018 | Nadzan et al. |
| 9,890,396 | B2 | 2/2018 | Chatterjee et al. |
| 9,909,142 | B2 | 3/2018 | Yazicioglu et al. |
| 9,920,097 | B2 | 3/2018 | Zhong et al. |
| 9,944,908 | B2 | 4/2018 | Vaten et al. |
| 9,976,157 | B2 | 5/2018 | Poraty-Gavra et al. |
| 10,011,640 | B2 | 7/2018 | Srivastava et al. |
| 10,072,251 | B2 | 9/2018 | Gao et al. |
| 10,077,291 | B2 | 9/2018 | Asokan et al. |
| 10,081,659 | B2 | 9/2018 | Chiorini et al. |
| 10,119,125 | B2 | 11/2018 | Vandenberghe et al. |
| 10,214,566 | B2 | 2/2019 | Schaffer et al. |
| 10,337,027 | B2 | 7/2019 | Puccio et al. |
| 10,369,193 | B2 | 8/2019 | Passini et al. |
| 10,385,320 | B2 | 8/2019 | Kay et al. |
| 10,392,632 | B2 | 8/2019 | Wright et al. |
| 10,406,244 | B2 | 9/2019 | Kay et al. |
| 10,414,803 | B2 | 9/2019 | Nathwani et al. |
| 10,426,844 | B2 | 10/2019 | Agbandje-McKenna et al. |
| 10,526,627 | B2 | 1/2020 | Skuratowicz et al. |
| 10,668,094 | B2 | 6/2020 | Karlish |
| 10,745,447 | B2 | 8/2020 | Asokan et al. |
| 10,907,176 | B2 | 2/2021 | Asokan et al. |
| 11,077,128 | B2 | 8/2021 | Karlish |
| 11,208,438 | B2 | 12/2021 | Asokan et al. |
| 2002/0192189 | A1 | 12/2002 | Xiao et al. |
| 2003/0017131 | A1 | 1/2003 | Park et al. |
| 2003/0053990 | A1 | 3/2003 | Rabinowitz et al. |
| 2003/0225017 | A1 | 12/2003 | Murdin et al. |
| 2004/0013645 | A1 | 1/2004 | Monahan et al. |
| 2004/0031072 | A1 | 2/2004 | La Rosa et al. |
| 2004/0071659 | A1 | 4/2004 | Chang et al. |
| 2004/0166519 | A1 | 8/2004 | Cargill et al. |
| 2004/0214272 | A1 | 10/2004 | La Rosa et al. |
| 2005/0287122 | A1 | 12/2005 | Bartlett et al. |
| 2006/0107345 | A1 | 5/2006 | Alexandrov et al. |
| 2006/0123505 | A1 | 6/2006 | Kikuchi et al. |
| 2006/0171926 | A1 | 8/2006 | Passini et al. |
| 2006/0236419 | A1 | 10/2006 | La Rosa et al. |
| 2007/0015238 | A1 | 1/2007 | Snyder et al. |
| 2007/0124833 | A1 | 5/2007 | Abad et al. |
| 2007/0196338 | A1 | 8/2007 | Samulski et al. |
| 2007/0243526 | A1 | 10/2007 | Kay et al. |

(56) References Cited

U.S. PATENT DOCUMENTS

| | | |
|---|---|---|
| 2008/0229439 A1 | 9/2008 | La Rosa et al. |
| 2009/0215879 A1 | 8/2009 | Diprimio et al. |
| 2009/0221620 A1 | 9/2009 | Luke et al. |
| 2009/0275107 A1 | 11/2009 | Lock et al. |
| 2009/0317417 A1 | 12/2009 | Vandenberghe et al. |
| 2010/0037352 A1 | 2/2010 | Alexandrov et al. |
| 2010/0047174 A1 | 2/2010 | Kay et al. |
| 2010/0095387 A1 | 4/2010 | Smith et al. |
| 2011/0061124 A1 | 3/2011 | Nadzan et al. |
| 2011/0067143 A2 | 3/2011 | La et al. |
| 2011/0131679 A2 | 6/2011 | La et al. |
| 2011/0209246 A1 | 8/2011 | Kovalic et al. |
| 2011/0214206 A1 | 9/2011 | La Rosa et al. |
| 2011/0236353 A1 | 9/2011 | Wilson et al. |
| 2011/0294218 A1 | 12/2011 | Chatterjee et al. |
| 2012/0009268 A1 | 1/2012 | Asokan et al. |
| 2012/0137379 A1 | 5/2012 | Gao et al. |
| 2012/0216318 A1 | 8/2012 | La Rosa et al. |
| 2012/0255046 A1 | 10/2012 | Kay et al. |
| 2012/0322861 A1 | 12/2012 | Byrne et al. |
| 2013/0096182 A1 | 4/2013 | Chatterjee et al. |
| 2013/0152224 A1 | 6/2013 | Abad et al. |
| 2013/0185831 A1 | 7/2013 | Kovalic et al. |
| 2013/0195801 A1 | 8/2013 | Gao et al. |
| 2013/0203841 A1 | 8/2013 | Zhong et al. |
| 2013/0216501 A1 | 8/2013 | Zhong et al. |
| 2013/0224836 A1 | 8/2013 | Muramatsu |
| 2013/0225666 A1 | 8/2013 | Kaspar et al. |
| 2013/0326723 A1 | 12/2013 | La Rosa et al. |
| 2014/0017212 A1 | 1/2014 | Rebar |
| 2014/0037585 A1 | 2/2014 | Wright et al. |
| 2014/0050701 A1 | 2/2014 | Zhong et al. |
| 2014/0056854 A1 | 2/2014 | Asokan et al. |
| 2014/0057969 A1 | 2/2014 | Frost et al. |
| 2014/0130203 A1 | 5/2014 | La Rosa et al. |
| 2014/0162319 A2 | 6/2014 | Hareendran et al. |
| 2014/0199313 A1 | 7/2014 | Plesch et al. |
| 2014/0223605 A1 | 8/2014 | Puzio et al. |
| 2014/0259218 A1 | 9/2014 | Kovalic et al. |
| 2014/0296486 A1 | 10/2014 | Gao et al. |
| 2014/0335054 A1 | 11/2014 | Gao et al. |
| 2014/0341852 A1 | 11/2014 | Srivastava et al. |
| 2015/0050302 A1 | 2/2015 | Thess |
| 2015/0079038 A1 | 3/2015 | Deverman et al. |
| 2015/0082481 A1 | 3/2015 | La Rosa et al. |
| 2015/0126588 A1 | 5/2015 | Nakai et al. |
| 2015/0133530 A1 | 5/2015 | Srivastava et al. |
| 2015/0184189 A1 | 7/2015 | Abad et al. |
| 2015/0191739 A1 | 7/2015 | La Rosa et al. |
| 2015/0197763 A1 | 7/2015 | La Rosa et al. |
| 2015/0238550 A1 | 8/2015 | McCown |
| 2015/0344911 A1 | 12/2015 | Chatterjee et al. |
| 2016/0017295 A1 | 1/2016 | Schaffer et al. |
| 2016/0025657 A1 | 1/2016 | Shahbazmohamadi et al. |
| 2016/0106865 A1 | 4/2016 | Zhong et al. |
| 2016/0215024 A1 | 7/2016 | Vandenberghe et al. |
| 2016/0222067 A1 | 8/2016 | Gao et al. |
| 2016/0256571 A1 | 9/2016 | Corral-Debrinski et al. |
| 2016/0264984 A1 | 9/2016 | La Rosa et al. |
| 2016/0289275 A1 | 10/2016 | Chiorini et al. |
| 2016/0319294 A1 | 11/2016 | Kovalic et al. |
| 2016/0333372 A1 | 11/2016 | Srivastava et al. |
| 2016/0361439 A1 | 12/2016 | Agbandje-McKenna et al. |
| 2016/0369299 A1 | 12/2016 | Boye et al. |
| 2017/0007720 A1 | 1/2017 | Boye et al. |
| 2017/0028082 A1 | 2/2017 | Wilson et al. |
| 2017/0049910 A1 | 2/2017 | Cronin et al. |
| 2017/0067908 A1 | 3/2017 | Nakai et al. |
| 2017/0088852 A1 | 3/2017 | Dangoor et al. |
| 2017/0088858 A1 | 3/2017 | Gao et al. |
| 2017/0096683 A1 | 4/2017 | Scaria et al. |
| 2017/0130245 A1 | 5/2017 | Kotin et al. |
| 2017/0159027 A1 | 6/2017 | Wilson et al. |
| 2017/0166926 A1 | 6/2017 | Deverman et al. |
| 2017/0204144 A1 | 7/2017 | Deverman et al. |
| 2017/0211092 A1 | 7/2017 | Chatterjee et al. |
| 2017/0211093 A1 | 7/2017 | Chatterjee et al. |
| 2017/0211094 A1 | 7/2017 | Chatterjee et al. |
| 2017/0211095 A1 | 7/2017 | Chatterjee et al. |
| 2017/0240885 A1 | 8/2017 | Deverman et al. |
| 2017/0275337 A1 | 9/2017 | Srivastava et al. |
| 2017/0298323 A1 | 10/2017 | Vandenberghe et al. |
| 2017/0349911 A1 | 12/2017 | Gao et al. |
| 2018/0002722 A1* | 1/2018 | Asokan .............. A61K 31/7088 |
| 2018/0030096 A1 | 2/2018 | Aslanidi et al. |
| 2018/0030479 A1 | 2/2018 | Gao et al. |
| 2018/0036428 A1 | 2/2018 | Zhong et al. |
| 2018/0066022 A1 | 3/2018 | Chalberg et al. |
| 2018/0066285 A1 | 3/2018 | Ojala et al. |
| 2018/0104289 A1 | 4/2018 | Venditti et al. |
| 2018/0105559 A1 | 4/2018 | Srivastava et al. |
| 2018/0112229 A1 | 4/2018 | Nadzan et al. |
| 2018/0119167 A1 | 5/2018 | Abad et al. |
| 2018/0135074 A1 | 5/2018 | Srivastava et al. |
| 2018/0135076 A1 | 5/2018 | Linden |
| 2018/0163227 A1 | 6/2018 | Chatterjee et al. |
| 2018/0214576 A1 | 8/2018 | Fitzgerald et al. |
| 2018/0244727 A1 | 8/2018 | Zhong et al. |
| 2018/0265863 A1 | 9/2018 | Esteves et al. |
| 2018/0355376 A1 | 12/2018 | Chiorini et al. |
| 2018/0362592 A1 | 12/2018 | Gao et al. |
| 2018/0371024 A1 | 12/2018 | Asokan et al. |
| 2019/0048041 A1 | 2/2019 | Asokan et al. |
| 2019/0055524 A1 | 2/2019 | Vandenberghe et al. |
| 2019/0085301 A1 | 3/2019 | Gao et al. |
| 2019/0100560 A1 | 4/2019 | Vandenberghe et al. |
| 2019/0249195 A1 | 8/2019 | Marsic et al. |
| 2019/0255192 A1 | 8/2019 | Kirn et al. |
| 2019/0262373 A1 | 8/2019 | Woodard et al. |
| 2019/0284576 A1 | 9/2019 | Qu et al. |
| 2019/0292561 A1 | 9/2019 | Qu et al. |
| 2019/0367562 A1 | 12/2019 | Asokan et al. |
| 2020/0109418 A1 | 4/2020 | Li et al. |
| 2020/0399321 A1 | 12/2020 | Asokan et al. |
| 2021/0115474 A1 | 4/2021 | McCoy et al. |
| 2021/0128652 A1 | 5/2021 | Dismuke |
| 2021/0324418 A1 | 10/2021 | Thomas et al. |
| 2021/0363191 A1 | 11/2021 | McCoy et al. |
| 2021/0371469 A1 | 12/2021 | McCoy et al. |
| 2021/0371471 A1 | 12/2021 | McCoy et al. |
| 2022/0056478 A1 | 2/2022 | O'Banion |
| 2022/0064675 A1 | 3/2022 | McCoy et al. |
| 2022/0088152 A1 | 3/2022 | Mikati |
| 2022/0089651 A1 | 3/2022 | Asokan et al. |

FOREIGN PATENT DOCUMENTS

| | | |
|---|---|---|
| EP | 1777296 A2 | 4/2007 |
| EP | 1887081 A2 | 2/2008 |
| EP | 2194140 A2 | 6/2010 |
| EP | 2359869 A2 | 8/2011 |
| EP | 2492347 A1 | 8/2012 |
| EP | 2315833 B1 | 4/2015 |
| EP | 1453547 B1 | 9/2016 |
| EP | 2007795 B1 | 11/2016 |
| EP | 2263692 B1 | 9/2018 |
| EP | 2206728 B9 | 10/2018 |
| EP | 3244931 B1 | 10/2018 |
| EP | 1633767 B1 | 11/2018 |
| EP | 3250239 B1 | 12/2018 |
| EP | 3459965 A1 | 3/2019 |
| EP | 3511021 A1 | 7/2019 |
| EP | 3108000 B1 | 8/2019 |
| JP | 2014534245 A | 12/2014 |
| JP | 2018/503376 A | 2/2018 |
| RU | 2457252 C2 | 7/2012 |
| WO | WO-9005142 A1 | 5/1990 |
| WO | WO-9811244 A2 | 3/1998 |
| WO | WO-9901555 A1 | 1/1999 |
| WO | WO-9961601 A2 | 12/1999 |
| WO | WO-0017377 A2 | 3/2000 |
| WO | WO-9961601 A9 | 3/2000 |
| WO | WO-0023477 A2 | 4/2000 |
| WO | WO-0028061 A9 | 11/2000 |

(56) References Cited

FOREIGN PATENT DOCUMENTS

| | | |
|---|---|---|
| WO | WO-0111034 A2 | 2/2001 |
| WO | WO-0181581 A2 | 11/2001 |
| WO | WO-0192551 A2 | 12/2001 |
| WO | WO-0210210 A2 | 2/2002 |
| WO | WO-03000906 A2 | 1/2003 |
| WO | WO-03008540 A2 | 1/2003 |
| WO | WO-03033515 A1 | 4/2003 |
| WO | WO-03042361 A2 | 5/2003 |
| WO | WO-03052051 A2 | 6/2003 |
| WO | WO-03095647 A2 | 11/2003 |
| WO | WO-2004027019 A2 | 4/2004 |
| WO | WO-2005033321 A2 | 4/2005 |
| WO | WO-2006021724 A2 | 3/2006 |
| WO | WO-2006029319 A2 | 3/2006 |
| WO | WO-2006066066 A2 | 6/2006 |
| WO | WO-2006073052 A1 | 7/2006 |
| WO | WO-2006119137 A1 | 11/2006 |
| WO | WO-2006119432 | 11/2006 |
| WO | WO-2007084773 A2 | 7/2007 |
| WO | WO-2007089632 A2 | 8/2007 |
| WO | WO-2007092563 A2 | 8/2007 |
| WO | WO-2007100465 A2 | 9/2007 |
| WO | WO-2007120542 A2 | 10/2007 |
| WO | WO-2007127264 A2 | 11/2007 |
| WO | WO-2008088895 A2 | 7/2008 |
| WO | WO-2009037279 A1 | 3/2009 |
| WO | WO-2009043936 A1 | 4/2009 |
| WO | WO-2009105612 A2 | 8/2009 |
| WO | WO-2009108274 A2 | 9/2009 |
| WO | WO-2010093784 A2 | 8/2010 |
| WO | WO-2010129021 A1 | 11/2010 |
| WO | WO-2010138263 A2 | 12/2010 |
| WO | WO-2011020118 A1 | 2/2011 |
| WO | WO-2011020710 A2 | 2/2011 |
| WO | WO-2011122950 A1 | 10/2011 |
| WO | WO-2011133890 A1 | 10/2011 |
| WO | WO-2012061744 A2 | 5/2012 |
| WO | WO-2012064960 A2 | 5/2012 |
| WO | WO-2012112578 A2 | 8/2012 |
| WO | WO-2012178173 A1 | 12/2012 |
| WO | WO-2013016315 A1 | 1/2013 |
| WO | WO-2013027223 A2 | 2/2013 |
| WO | WO-2013158879 A1 | 10/2013 |
| WO | WO-2013170078 A1 | 11/2013 |
| WO | WO-2013173512 A1 | 11/2013 |
| WO | WO-2013190059 A1 | 12/2013 |
| WO | WO-2014007858 A1 | 1/2014 |
| WO | WO-2014045674 A1 | 3/2014 |
| WO | WO-2014124282 A1 | 8/2014 |
| WO | WO-2014144229 A1 | 9/2014 |
| WO | WO-2014153083 A1 | 9/2014 |
| WO | WO-2014193716 A2 | 12/2014 |
| WO | WO-2014194132 A1 | 12/2014 |
| WO | WO-2015013313 A2 | 1/2015 |
| WO | WO-2015038958 A1 | 3/2015 |
| WO | WO-2015054653 A2 | 4/2015 |
| WO | WO-2015121501 A1 | 8/2015 |
| WO | WO-2015164757 A1 | 10/2015 |
| WO | WO-2015168666 A2 | 11/2015 |
| WO | WO-2015181823 A1 | 12/2015 |
| WO | WO-2015191508 A1 | 12/2015 |
| WO | WO-2016054557 A1 | 4/2016 |
| WO | WO-2016065001 A1 | 4/2016 |
| WO | WO-2016081811 A1 | 5/2016 |
| WO | WO-2016115382 A1 | 7/2016 |
| WO | WO-2016115503 A1 | 7/2016 |
| WO | WO-2016128558 A1 | 8/2016 |
| WO | WO-2016128559 A1 | 8/2016 |
| WO | WO-2016134338 A1 | 8/2016 |
| WO | WO-2016150964 A1 | 9/2016 |
| WO | WO-2016164642 A1 | 10/2016 |
| WO | WO-2016172008 A1 | 10/2016 |
| WO | WO-2016172155 A1 | 10/2016 |
| WO | WO-2016179644 A1 | 11/2016 |
| WO | WO-2017015102 A1 | 1/2017 |
| WO | WO-2017058892 A2 | 4/2017 |
| WO | WO-2017066764 A2 | 4/2017 |
| WO | WO-2017070516 A1 | 4/2017 |
| WO | WO-2017/077451 A1 | 5/2017 |
| WO | WO-2017096164 A1 | 6/2017 |
| WO | WO-2017106236 A1 | 6/2017 |
| WO | WO-2017139643 A1 | 8/2017 |
| WO | WO-2017143100 A1 | 8/2017 |
| WO | WO-2017147123 A1 | 8/2017 |
| WO | WO-2017180854 A1 | 10/2017 |
| WO | WO-2017192750 A1 | 11/2017 |
| WO | WO-2017201248 A1 | 11/2017 |
| WO | WO-2018022608 A2 | 2/2018 |
| WO | WO-2018035213 A1 | 2/2018 |
| WO | WO-2018049226 A1 | 3/2018 |
| WO | WO-2018064624 A1 | 4/2018 |
| WO | WO-2018075798 A1 | 4/2018 |
| WO | WO-2018119330 A2 | 6/2018 |
| WO | WO-2018152333 A1 | 8/2018 |
| WO | WO-2018160582 A1 | 9/2018 |
| WO | WO-2018170310 A1 | 9/2018 |
| WO | WO-2018204764 A1 | 11/2018 |
| WO | WO-2018209154 A1 | 11/2018 |
| WO | WO-2018226785 A1 | 12/2018 |
| WO | WO-2018237066 A1 | 12/2018 |
| WO | WO-2019006418 A2 | 1/2019 |
| WO | WO-2019025984 A1 | 2/2019 |
| WO | WO-2019141765 A1 | 7/2019 |
| WO | WO-2019168961 A1 | 9/2019 |
| WO | WO-2019169132 A1 | 9/2019 |
| WO | WO-2019173434 A1 | 9/2019 |
| WO | WO-2019173538 A1 | 9/2019 |
| WO | WO-2019178412 A1 | 9/2019 |
| WO | WO-2019195423 A1 | 10/2019 |
| WO | WO-2019195444 A1 | 10/2019 |
| WO | WO-2019195449 A1 | 10/2019 |
| WO | WO-2019222444 A2 | 11/2019 |
| WO | WO-2020016318 A1 | 1/2020 |
| WO | WO-2020106916 A1 | 5/2020 |
| WO | WO-2020142653 | 7/2020 |
| WO | WO-2020191300 A1 | 9/2020 |
| WO | WO-2020232297 A1 | 11/2020 |
| WO | WO-2021076911 A1 | 4/2021 |
| WO | WO-2021076925 A1 | 4/2021 |

OTHER PUBLICATIONS

Ye, et al., Safety and Biodistribution Evaluation in Cynomolgus Macaques of rAAV2tYF-PR1.7-hCNGB3, a Recombinant AAV Vector for Treatment of Achromatopsia, 2016, Human Gene Therapy Clinical Development, vol. 27 No. 1, p. 37-48 (Year: 2016).*

Bowman, L., Mutagenesis of AAV Capsid Proteins for Enhanced Transduction of Cardiac Cell Types (2015) Temple University, PA (Year: 2015).*

Mowat et al., "Tyrosine capsid-mutant AAV vectors for gene delivery to the canine retina from a subretinal or intravitreal approach," Gene Ther 21(1):96-105 (2014).

Zifei et al., "Improving recombinant glandular Studies on the transduction efficiency of related viruses Study the status quo" Biotechnology Bulletin, 31(9):49-59 (2015).

Asokan et al., "The AVV Vector Toolkit: Poised at the Clinical Crossroads," Molecular Therapy 20(4):699-708 (2012).

Bantel-Schaal et al., "Adeno-associated virus type 5 exploits two different entry pathways in human embryo fibroblast," J Virology 73:939 (1999).

Bennett et al. "AAV6 K531 serves a dual function in selective receptor and antibody ADK6 recognition" Virology, 18:369-376 (2018).

Clapcote SJ, et al., " Mutation I810N in the alpha3 isoform of Na+,K+-ATPase causes impairments in the sodium pump and hyperexcitability in the CNS," Proc Natl Acad Sci USA. 106(33):14085-14090 (2009).

Extended European Search Report issued by the European Patent Office for Application No. 19760157.8, dated Nov. 18, 2021, 7 pages.

(56) References Cited

OTHER PUBLICATIONS

Piguet Françoise et al., "Rapid and Complete Reversal of Sensory Ataxia by Gene Therapy in a Novel Model of Friedreich Ataxia", Molecular Therapy, Nature Publishing Group, GB 26(8), pp. 1-13 (2018).
Ghusayni R, et al., "Magnetic resonance imaging volumetric analysis in patients with Alternating hemiplegia of childhood: A pilot study," Eur J Paediatr Neural. 26:15-19 (2020).
Heinzen EL, et al., "De nova mutations in ATP1A3 cause alternating hemiplegia of childhood," Nat Genet. 44 (9):1030-1034 (2012).
Helseth AR, et al., "Novel E815K knock-in mouse model of alternating hemiplegia of childhood," Neurobiol Dis. 119:100-112 (2018).
Holm R, et al., "B. Neurological disease mutations of a3 Na+,K+-ATPase: Structural and functional perspectives and rescue of compromised function," Biochim Biophys Acta. 1857(11):1807-1828 (2016).
Hunanyan AS, et al., Knock-in mouse model of alternating hemiplegia of childhood: behavioral and electrophysiologic characterization. Epilepsia. 56(1):82-93 (2015).
Hunanyan AS, et al., "Mechanisms of increased hippocampal excitability in the Mashl+/- mouse model of Na+ /K+ -ATPase dysfunction," Epilepsia 59(7):1455-1468 (2018).
Ikeda K, et al., "Knockout of sodium pump a3 subunit gene (Atp1a3-/-) results in perinatal seizure and defective respiratory rhythm generation," Brain Res. 1666:27-37 (2017).
International Search Report and Written Opinion issued by the International Searching Authority for Application No. PCT/US2021/030937, dated Oct. 29, 2021, 14 pages.
Invitation to Pay issued by the International Searching Authority for Application No. PCT/US21/30937, dated Aug. 16, 2021, 3 pages.
International Search Report and Written Opinion issued by the International Searching Authority for Application No. PCT/US2022/012542, dated Jun. 3, 2022, 10 pages.
Isaksen TJ, et al., "Hypothermia-induced dystonia and abnormal cerebellar activity in a mouse model with a single disease-mutation in the sodium-potassium pump," PLoS Genet. 13(5):e1006763, pp. 1-23 (2017).
Kells Adrian P. et al: "AAV-Mediated gene delivery of BDNF or GDNF is neuroprotective in a model of huntington disease", Molecular Therapy 9(5):682-688 (2004).
Kirshenbaum GS, et al., "Alternating hemiplegia of childhood-related neural and behavioural phenotypes in Na +, K+-ATPase a3 missense mutant mice," PLoS One. 8(3):e60141, pp. 1-15 (2013).
Kuck et al. "Development of AAV serotype-specific ELISAs using novel monoclonal antibodies" Journal of Virological Methods, 140(1-2):17-24 (2007) (Abstract only).
Lux et al. "Green Fluorescent Protein-Tagged Adeno-Associated Virus Particles Allow the Study of Cytosolic and Nuclear Trafficking" Journal of Virology, 79(18):11776-11787 (2005).
Masoud M, et al., "Diagnosis and Treatment of Alternating Hemiplegia of Childhood," Curr Treat Options Neurol. 19(2):8 (2017).
McCraw et al. "structurE of adeno-associated virus-2 In Complex with Neutralizing Monoclonal antibody A20" Virology, 431(1-2):40-49 (2012).
Mikati MA, et al., "Alternating hemiplegia of childhood: clinical manifestations and long-term outcome," Pediatr Neurol. 23(2):134-141 (2000).
Pearson & Lipman, "Improved tools for biological sequence comparison," Proc. Natl. Acad. Sci. USA 85, 2444-2448 (1988).
Powell et al. Characterization of a Novel Adena-Associated Viral Vector with Preferential Oligodendrocyte Tropism. Gene Therapy, 2016. 23:807-814.
Severino M, et al., "White matter and cerebellar involvement in alternating hemiplegia of childhood," J Neurol. 267 (5):1300-1311 (2020).
Veron et al. "Humeral and Cellular Capsid-Specific Immune Responses to Adena-Associated Virus Type 1 in andomized Healthy Donors" The Journal of Immunology, 188:6418-6424 (2012).
Wang; Q. et al., "Identification of an adeno-associated Virus binding epitope for AVB sepharose affinity resin," Molecular Therapy—Methods & Clinical Development vol. 2, pp. 1-6 (2015).
Wobus et al. "Monoclonal Antibodies against the Adeno-Associated Virus Type 2 {AAV-2) Capsid: Epitope Mapping nd Identification of Capsid Domains Involved in AAV-2-Cell Interaction and Neutralization of AAV-2 Infection" J. of Virology, 74:9281-9293 (2000).
Ye Q, et al., "The AAA+ ATPase TRIP13 remodels HORMA domains through N-terminal engagement and unfolding," EMBO J. 36(16):2419-2434 (2017).
Zhong et al. "Next generation of adeno-associated virus 2 vectors: Point mutations in tyrosines lead to high-efficienc ransduction at lower doses" Proceedings of the National Academy of Sciences USA, 105(22):7827-7832 (2008).
Zhong et al. "Tyrosine-phosphorylation of AAV2 vectors and its consequences on viral intracellular trafficking and transgene expression" Virology, 381(2):194-202 (2008).
Zolotukhin et al. "Production and purification of serotype 1, 2, and 5 recombinant adeno-associated viral vectors" Methods, 28(2):158-167 (2002) (Abstract only).
ACS on STN, BD Registry, 1182714-10-8 [online] [retrieved on Apr. 30, 2019], 2009215879, Aug. 27, 2009, SEQ ID No. 7.
ACS on STN, BD Registry, 1182714-97-1 [online] [retrieved on Apr. 30, 2019], 2009215879, Aug. 27, 2009, SEQ ID No. 210.
Adachi et al., "Drawing a high-resolution functional map of adeno-associated virus capsid by massively parallel sequencing," Nature Communications 5(1): 14 pages (2013).
Agbandje et al. "The Structure of Human Parvovir B19 at 8 A; Resolution" Virology 203(1):106-115 (1994).
Agbandje-McKenna et al. "AAV Capsid Structure and Cell Interactions" Methods in Molecular Biology, 807:47-92 (2011).
Albright et al., "Mapping the Structural Determinants Required for AAVrh.10 Transport across the Blood-Brain Barrier," Molecular Therapy 26(2), p. 1-14 (2017).
Albright, "Modulation of Sialic Acid Dependence Influences the Central Nervous System Transduction Profile of Adeno-associated Viruses," Journal of Virology 93(11), pp. 1-15 (2019).
Altschul et al. "Basic Local Alignment Search Tool" Journal of Molecular Biology 215:403-410 (1990).
Altschul et al., "Gapped BLAST and PSI-BLAST: a new generation of protein database search programs," Nucleic Acids Res. (1997) 25(17):3389-3402.
Altschul et al. "Local Alignment Statistics" Methods in Enzymology 266:460-480 (1996).
Andino et al. "AAV-mediated knockdown of phospholamban leads to improved contractility and calcium handling in cardiomyocytes" The Journal of Gene Medicine 10:132-142 (2008).
Arnold et al., "A calcium responsive element that regulates expression of two calcium binding proteins in Purkinje cells," Proc Natl Acad Sci USA 94(16):8842-8847 (1997).
Arrunda et al., "Regional intravascular delivery of AAV-2-F.IX to skeletal muscle achieves long-term correction of hemophilia B in a large animal model," Blood 105:3458-3464 (2005).
Askoan et al. "Adeno-Associated Virus Type 2 Contains an Integrin a5 1 Binding Domain Essential for Viral Cell Entry" Journal of Virology, 80(18):8961-8969 (2006).
Asokan, et al., "Reengineering a receptor footprint of adeno-associated virus enables selective and systemic gene transfer to muscle", Nat Biotechnol, (Jan. 2010); 28(1): 79-82.
Asuri et al., Directed Evolution of adeno-associated Virus for Enhanced Gene Delivery and Gene Targeting in Human Pluripotent Stem Cells, Molecular Therapy, Nature Publishing Group GB 20(2):329-338 (2013).
Ballabh et al. "The blood-brain barrier: an overview: structure, regulation, and clinical implications" Neurobiology of Disease, 16:1-13 (2004).
Bantel-Schaal et al. "Human adeno-Associated Virus Type 5 Is Only Distantly Related to Other Known Primate Helper-Dependent Parvovirus" Journal of Virology 73(2):939-947 (1999).
Bartlett, JS et al., 'Selective and Rapid Uptake of Adeno-Associated Virus Type 2 in Brain,' Hum. Gene Ther., 9(8):1181-1186, (May 1998).

(56) References Cited

OTHER PUBLICATIONS

Bell et al. "Identification of the Galactose Binding Domain of the Adeno-Associated Virus Serotype 9 Capsid" Journal of Virology, 86(13):7326-7333 (2012).
Bleker et al. "Mutational Analysis of Narrow Pores at the Fivefold Symmetry Axes of Adeno-Associated Virus Type 2 Capsids Reveals a Dual Role in Genome Packaging and Activation of Phospholipase A2 Activity" Journal of Virology, 79(4):2528-2540 (2005).
Bordoli et al. "Protein structure homology modeling using SWISS-MODEL workspace" Nature Protocols, 4(1):1-13 (2008).
Bowie, et al., "Deciphering the Message in Protein Sequences: Tolerance to Amino Acid Substitutions." Science (1990); 247: 1306-1310.
Bowles et al. "Phase 1 Gene Therapy for Duchenne Muscular Dystrophy Using a Translational Optimized AAV Vector" Molecular Therapy, 20(2):443-455 (2012).
Brichard et al. "The Tyrosinase Gene Codes for an Antigen Recognized by Autologous Cytolytic T Lymphocytes on HLA-AZ Melanomas" Journal of Experimental Medicine178:489-495 (1993).
Brown et al. "Chimeric Parvovir 19 Capsids for the Presentation of Foreign Epitopes" Virology 198(2):477-488 (1994).
Brown et al. "Erythrocyte P Antigen: Cellular Receptor for B19 Parvovir" Science 262(5130):114-117 (1993).
Carrillo-Tripp et al. "VIPERdb2: an enhanced and web API enabled relational database for structural virology" Nucleic Acids Research, 37:D436-D442 (2009).
Carstea, ED et al. 'Niemann-Pick C1 Disease Gene: Homology to Mediators of Cholesterol Homeostasis,' Science, 277(5323): 228-231 (Jul. 1997).
Cearley, C.N. et al. (2008). "Expanded repertoire of AAV vector serotypes mediate unique patterns of transduction in mouse brain," Mol. Ther. 16:1710-1718.
Cearley et al. "Transduction Characteristics of Adeno-associated Virus Vectors Expressing Cap Serotypes 7, 8, 9, and Rh10 in the Mouse Brain" Molecular Therapy, 13(3):528-537 (2006).
Chandler et al., "Systemic AAV9 gene therapy improves the lifespan of mice with Niemann-Pick disease, type C1," Human Molecular Genetics 26(1):52-64 (2017).
Chao et al. "Several Log Increase in Therapeutic Transgene Delivery by Distinct Adeno-Associated Viral Serotype Vectors" Molecular Therapy 2(6):619-623 (2000).
Chapman et al. "Structure, Sequence, and Function Correlations among Parvoviruses" Virology 194(2):491-508 (1993).
Chen et al. "Efficient Transduction of Vascular Endothelial Cells with Recombinant Adeno- Associated Virus Serotype 1 and 5 Vectors" Human Gene Therapy, 16(2):235-247 (2005).
Chen, SH et al., 'Gene therapy for brain tumors: Regression of experimental gliomas by adenovirus-mediated gene transfer in vivo,' Proc. Natl Acad. Sci. USA, vol. 91, pp. 3054-3057, (Apr. 1994).
Chiorini et al. "Cloning and Characterization of adeno-Associated Virus Type 5" Journal of Virology 73(2):1309-1319 (1999).
Chiorini et al. "Cloning of adeno-Associated Virus Type 4 (AAV4). and Generation of Recombinant AAV4 Particles" Journal of Virology 71(9):6823-6833 (1997).
Chipman et al. "Cryo-electron microscopy studies of empty capsids of human parvovirus 819 complexed with its cellular receptor" Proceedings of the National Academy of Sciences 93:7502-7506 (1996).
Chirmule et al., "Humoral immunity to adeno-associated virus type 2 vectors following administration to murine and nonhuman primate muscle," Journal of Virology, The American Society for Microbiology, , 74(5):2420-2425 (2000).
Choi et al., "Optimization of AAV expression cassettes to improve packaging capacity and transgene expression in neurons," Molecular Brain, Biomed Central Ltd, London UK, 7(1):17 pages 1-10 (2014).

Clark, KR et al., 'Highly Purified Recombinant Adeno-Associated Virus Vectors Are Biologically Active and Free of Detectable Helper and Wild-Type Viruses,' Hum. Gene Ther., 10(6):1031-1039, (Apr. 1999).
Cleves, Ann E. "Protein transport: The nonclassical ins and outs" Current Biology7:R318-R320 (1997).
Conway et al. "High-titer recombinant adeno-associated virus production utilizing a recombinant herpes simplex virus type 1 vector expressing AAV-2 Rep and Cap" Gene Therapy 6:986-993 (1999).
Corpet, F et al., 'Multiple sequence alignment with hierarchical clustering,' vol. 16 No. 22, pp. 10881-10890, (Oct. 1988).
Cotmore et al.,"The Family Parvoviridae," Archives of Virology 159:1239-1247 (2014).
DataBase GenBank: ABS91093.1, Aug. 10, 2007, [online] [retrieved on Feb. 14, 2020] Retrieved from Internet: https://www.ncbi.nlm.nih.gov/protein/ABS91093.1.
DataBase GenBank: ACW56705.1, Sep. 24, 2009, [online] [retrieved on May 7, 2019] Retrieved from Internet:https://www.ncbi.nlm.nih.gov/protein/ACW56705.1?report=genbank&log$=prottop&blast_rank= 1&RID=D2CZ8TP9014, 1 page.
de Jesus et al., "Telomerase gene therapy in adult and old mice delays aging and increases longevity without increasing cancer," EMBO Mol. Med. 4(8): 691-704 (2012).
Devereux et al. "A comprehensive set of sequence analysis programs for the VAX" Nucleic Acids Research 12(1):387-395 (1984).
Deverman, BE, Cre-dependent selection yields AAV variants for widespread gene transfer to the adult brain, Nat. Biotechnol., 34(2):204-209. doi: 10.1038/nbt.3440. PubMed PMID: 26829320 (Epub Feb. 1, 2016).
Dimattia et al. "Structural Insight into the Unique Properties of Adeno-Associated Virus Serotype 9," Journal of Virology, 86(12):6947-6958 (2012).
Dipasquale et al. "Identification of PDGFR as a receptor for MV-5 transduction" Nature Medicine, 9:1306-1312 (2003). (Abstract only).
Diprimo, et al., "Surface loop dynamics in adeno-associated virus capsid assembly", Journal of Virology (2008); vol. 82, No. 11, pp. 5178-5189.
Emsley et al. "Features and development of Coot" Acta Crystallographica Section D: Biological Crystallography, D66:486-501 (2010).
Extended European Search Report corresponding to European Patent Application No. 20212583.7, dated May 3, 2021, 10 pages.
Fang et al., "Stable antibody expression at therapeutic levels using the 2A peptide," Nature Biotechnology 23:584-590 (2005).
Felsenstein, Joseph "Confidence Limits on Phylogenies: An Approach Using the Bootstrap" Evolution, 39 (4):783-791 (1985).
Ferrari et al. "New developments in the generation of Ad-free high-titer rAAV gene therapy vectors" Nature Medicine 3(11):1295-1297 (1997).
Fisher, KJ et al., 'Transduction with Recombinant Adeno-Associated Virus for Gene Therapy Is Limited by Leading-Strand Synthesis,' J. Viral., 70(1):520-532 (LFU assay) (Jan. 1996).
Foster et al., "Emerging Immunotherapies for Authoimmune Kidney Disease," Hyman Vaccines & Immunotherapeutics 15(4):876-890 (2019).
Foust et al. "Intravascular AAV9 preferentially targets neonatal neurons and adult astrocytes" Nature Biotechnology, 27(1):59-65 (2009).
Gao et al. "Adeno-associated viruses undergo substantial evolution in primates during natural infections" Proceedings of the National Academy of Sciences, 100(10):6081-6086 (2003).
Gao et al. "Clades of adeno-Associated Vires are Widely Disseminated in Human Tissues" Journal of Virology 78(12):6381-6388 (2004).
Gao et al. "Novel adeno-associated viruses from Rhesus Monkeys as Vectors for human gene therapy," Proceedings of the National Academy of Sciences 99(18):11854-11859 (2002).
Genbank Accession No. AAR26465, Bovine Adeno-Associated Virus, dated May 25, 2004, 2 pages.
Genbank Accession No. AAT46339, capsid protein [Adeno-associated virus 11], dated Nov. 30, 2004, 2 pages.
Genbank Accession No. ABI16639, VP1 [Adeno-associated virus 12, dated Feb. 20, 2008, 2 pages.

(56) References Cited

OTHER PUBLICATIONS

GenBank Accession No. AF028704 "Adeno-associated virus 6, complete genome," Jan. 12, 1998 [online]. (Retrieved online Feb. 21, 2019].
GenBank Accession No. AF028705 "adeno-associated Virus 3B, complete genome" NCBI (2 pages). (Jan. 12, 1998).
GenBank Accession No. AF043303 "Adeno-associated virus 2, complete genome," May 20, 2010 [online]. (Retrieved online Feb. 21, 2019].
GenBank Accession No. AF063497 "Adeno-associated virus 1, complete genome," Apr. 27, 1999 [online]. (Retrieved online Feb. 21, 2019].
Genbank Accession No. AF085716, Adeno-associated virus 5 DNA binding trs helicase (Rep22) and capsid protein (VP1) genes, complete cds., dated Feb. 9, 1999, 3 pages.
GenBank Accession No. AF258783.1 'Felis catus Niemann-Pick type C1 disease protein (NPC1) mRNA, complete eds' (2000).
GenBank Accession No. AF288061 "Hamster parvoVirus 5' terminal hairpin gene sequence" NCBI (1 page). (Apr. 13, 2001), replaced by AH009962.
GenBank Accession No. AF513851 "Adeno-associated virus 7 nonstructural protein and capsid protein genes, complete cds," Sep. 5, 2002 [online]. (Retrieved online Feb. 21, 2019].
GenBank Accession No. AF513852 "Adeno-associated virus 8 nonstructural protein and capsid protein genes, complete cds," Sep. 5, 2002 [online]. (Retrieved online Feb. 21, 2019].
GenBank Accession No. AH009962 "Hamster parvovir" NCBI (1 page). (Aug. 25, 2016), replaced AF288061.
GenBank Accession No. AY028223 "B19 Virus isolate patient_A.1.1 genomic sequence" NCB/ (1 page). (Apr. 16, 2001).
GenBank Accession No. AY028226 "819 Virus isolate patient_A.2.1 genomic sequence" NCB/ (1 page). (Apr. 16, 2001).
Genbank Accession No. AY186198, Avian adeno-associated virus ATCC VR-865, complete genome, dated Jun. 5, 2003, 3 pages.
Genbank Accession No. AY242997, Non-Human primate Adeno-associated virus isolate AAVrh.8 capsid protein (VP1) gene, complete cds, dated May 14, 2003, 2 pages.
Genbank Accession No. AY242998, Non-Human primate Adeno-associated virus isolate AAVrh.37 capsid protein (VP1) gene, complete cds, dated May 14, 2003, 2 pages.
Genbank Accession No. AY242999, Non-Human primate Adeno-associated virus isolate AAVrh.36 capsid protein (VP1) gene, complete cds, dated May 14, 2003, 2 pages.
Genbank Accession No. AY243000, Non-Human primate Adeno-associated virus isolate AAVrh.35 capsid protein (VP1) gene, complete cds, dated May 14, 2003, 2 pages.
Genbank Accession No. AY243001, Non-Human Primate Adeno-associated Virus Isolate AAVrh.34 capsid protein (VP1) gene, complete cds., dated May 14, 2003, 2 pages.
Genbank Accession No. AY243002, Non-Human Primate Adeno-associated Virus Isolate AAVrh.33 capsid protein (VP1) gene, complete cds. dated May 14, 2003, 2 pages.
Genbank Accession No. AY243003, Non-Human Primate Adeno-associated Virus Isolate AAVrh.32 capsid protein (VP1) gene, complete cds, dated May 14, 2003, 2 pages.
Genbank Accession No. AY243007, Non-Human Primate Adeno-associated Virus Isolate AAVrh.2 capsid protein (VP1) gene, complete cds, dated May 14, 2003, 2 pages.
Genbank Accession No. AY243013, Non-Human primate Adeno-associated virus isolate AAVrh.13 capsid protein (VP1) gene, complete cds, dated May 14, 2003, 2 pages.
Genbank Accession No. AY243015, Non-Human primate Adeno-associated virus isolate AAVrh.10 capsid protein (VP1) gene, complete cds dated May 14, 2003, 2 pages.
Genbank Accession No. AY243016, Non-Human primate Adeno-associated virus isolate AAVcy.6 capsid protein (VP1) gene, complete cds dated May 14, 2003, 2 pages.
Genbank Accession No. AY243017, Non-Human primate Adeno-associated virus isolate AAVcy.5 capsid protein (VP1) gene, complete cds, dated May 14, 2003, 2 pages.
Genbank Accession No. AY243018, Non-Human primate Adeno-associated virus isolate AAVcy.4 capsid protein (VP1) gene, complete cds, dated May 14, 2003, 2 pages.
Genbank Accession No. AY243019, Non-Human primate Adeno-associated virus isolate AAVcy.3 capsid protein (VP1) gene, complete cds, dated May 14, 2003, 2 pages.
Genbank Accession No. AY243020, Non-Human primate Adeno-associated virus isolate AAVcy.2 capsid protein (VP1) gene, complete cds, dated May 14, 2003, 2 pages.
Genbank Accession No. AY243021, Non-Human primate Adeno-associated virus isolate AAVch.5 capsid protein (VP1) gene, complete cds, dated May 14, 2003, 2 pages.
Genbank Accession No. AY243023, Non-Human primate Adeno-associated virus isolate AAVbb.1 capsid protein (VP1) gene, complete cds, dated May 14, 2003, 2 pages.
Genbank Accession No. AY388617, Bovine adeno-associated virus, complete genome, dated May 25, 2004, 3 pages.
Genbank Accession No. AY530553, Adeno-associated virus isolate pi.1 capsid protein VP1 (cap) gene, complete cds, dated Jun. 24, 2004, 2 pages.
Genbank Accession No. AY530554, Adeno-associated virus isolate pi.2 capsid protein VP1 (cap) gene, complete cds, dated Jun. 24, 2004, 2 pages.
Genbank Accession No. AY530555, Adeno-associated virus isolate pi.3 capsid protein VP1 (cap) gene, complete cds, dated Jun. 24, 2004, 2 pages.
Genbank Accession No. AY530556, Adeno-associated virus isolate rh.1 capsid protein VP1 (cap) gene, complete cds, dated Jun. 24, 2004, 2 pages.
Genbank Accession No. AY530557, Adeno-associated virus isolate rh.25 capsid protein VP1 (cap) gene, complete cds, dated Jun. 24, 2004, 2 pages.
Genbank Accession No. AY530558, Adeno-associated virus isolate rh.38 capsid protein VP1 (cap) gene, complete cds, dated Jun. 24, 2004, 2 pages.
Genbank Accession No. AY530559, Adeno-associated virus isolate rh.40 capsid protein VP1 (cap) gene, complete cds, dated Jun. 24, 2004, 2 pages.
Genbank Accession No. AY530560, Adeno-associated virus isolate rh.43 capsid protein VP1 (cap) gene, complete cds, dated Jun. 24, 2004, 2 pages.
Genbank Accession No. AY530561, Adeno-associated virus isolate rh.48 capsid protein VP1 (cap) gene, complete cds, dated Jun. 24, 2004, 2 pages.
Genbank Accession No. AY530562, Adeno-associated virus isolate rh.49 capsid protein VP1 (cap) gene, complete cds, dated Jun. 24, 2004, 2 pages.
Genbank Accession No. AY530563, Adeno-associated virus isolate rh.50 capsid protein VP1 (cap) gene, complete cds, dated Jun. 24, 2004, 2 pages.
Genbank Accession No. AY530564, Adeno-associated virus isolate rh.51 capsid protein VP1 (cap) gene, complete cds, dated Jun. 24, 2004, 2 pages.
Genbank Accession No. AY530565, Adeno-associated virus isolate rh.52 capsid protein VP1 (cap) gene, complete cds, dated Jun. 24, 2004, 2 pages.
Genbank Accession No. AY530566, Adeno-associated virus isolate rh.53 capsid protein VP1 (cap) gene, complete cds, dated Jun. 24, 2004, 2 pages.
Genbank Accession No. AY530567, Adeno-associated virus isolate rh.54 capsid protein VP1 (cap) gene, complete cds, dated Jun. 24, 2004, 2 pages.
Genbank Accession No. AY530568, Adeno-associated virus isolate rh.55 capsid protein VP1 (cap) gene, complete cds, dated Jun. 24, 2004, 2 pages.
Genbank Accession No. AY530569, Adeno-associated virus isolate rh.57 capsid protein VP1 (cap) gene, complete cds, dated Jun. 24, 2004, 2 pages.
Genbank Accession No. AY530570, Adeno-associated virus isolate rh.58 capsid protein VP1 (cap) gene, complete cds, dated Jun. 24, 2004, 2 pages.

(56) References Cited

OTHER PUBLICATIONS

Genbank Accession No. AY530572, Adeno-associated virus isolate rh.61 capsid protein VP1 (cap) gene, complete cds, dated Jun. 24, 2004, 2 pages.
Genbank Accession No. AY530573, Adeno-associated virus isolate rh.62 capsid protein VP1 (cap) gene, complete cds, dated Jun. 24, 2004, 2 pages.
Genbank Accession No. AY530574, Adeno-associated virus isolate rh.64 capsid protein VP1 (cap) gene, complete cds, dated Jun. 24, 2004, 2 pages.
Genbank Accession No. AY530575, Adeno-associated virus isolate hu.1 capsid protein VP1 (cap) gene, complete cds, dated Jun. 24, 2004, 2 pages.
Genbank Accession No. AY530576, Adeno-associated virus isolate hu.10 capsid protein VP1 (cap) gene, complete cds, dated Jun. 24, 2004, 2 pages.
Genbank Accession No. AY530577, Adeno-associated virus isolate hu.11 capsid protein VP1 (cap) gene, complete cds, dated Jun. 24, 2004, 2 pages.
Genbank Accession No. AY530578, Adeno-associated virus isolate hu.13 capsid protein VP1 (cap) gene, complete cds, dated Jun. 24, 2004, 2 pages.
GenBank Accession No. AY530579 "adeno-associated Virus 9 isolate hu.14 capsid protein VP1 (cap). gene, complete cds" NCBI (2 pages). (Jun. 24, 2004).
Genbank Accession No. AY530580, Adeno-associated virus isolate hu.15 capsid protein VP1 (cap) gene, complete cds, dated Jun. 24, 2004, 2 pages.
Genbank Accession No. AY530581, Adeno-associated virus isolate hu.16 capsid protein VP1 (cap) gene, complete cds, dated Jun. 24, 2004, 2 pages.
Genbank Accession No. AY530582, Adeno-associated virus isolate hu.17 capsid protein VP1 (cap) gene, complete cds, dated Jun. 24, 2004, 2 pages.
Genbank Accession No. AY530583, Adeno-associated virus isolate hu.18 capsid protein VP1 (cap) gene, complete cds, dated Jun. 24, 2004, 2 pages.
Genbank Accession No. AY530584, Adeno-associated virus isolate hu.19 capsid protein VP1 (cap) gene, complete cds, dated Jun. 24, 2004, 2 pages.
Genbank Accession No. AY530585, Adeno-associated virus isolate hu.2 capsid protein VP1 (cap) gene, complete cds, dated Jun. 24, 2004, 2 pages.
Genbank Accession No. AY530586, Adeno-associated virus isolate hu.20 capsid protein VP1 (cap) gene, complete cds, dated Jun. 24, 2004, 2 pages.
Genbank Accession No. AY530587, Adeno-associated virus isolate hu.21 capsid protein VP1 (cap) gene, complete cds, dated Jun. 24, 2004, 2 pages.
Genbank Accession No. AY530588, Adeno-associated virus isolate hu.22 capsid protein VP1 (cap) gene, complete cds, dated Jun. 24, 2004, 2 pages.
Genbank Accession No. AY530589, Adeno-associated virus isolate hu.23 capsid protein VP1 (cap) gene, complete cds, dated Jun. 24, 2004, 2 pages.
Genbank Accession No. AY530590, Adeno-associated virus isolate hu.24 capsid protein VP1 (cap) gene, complete cds, dated Jun. 24, 2004, 2 pages.
Genbank Accession No. AY530591, Adeno-associated virus isolate hu.25 capsid protein VP1 (cap) gene, complete cds, dated Jun. 24, 2004, 2 pages.
Genbank Accession No. AY530592, Adeno-associated virus isolate hu.27 capsid protein VP1 (cap) gene, complete cds, dated Jun. 24, 2004, 2 pages.
Genbank Accession No. AY530593, Adeno-associated virus isolate hu.28 capsid protein VP1 (cap) gene, complete cds, dated Jun. 24, 2004, 2 pages.
Genbank Accession No. AY530594, Adeno-associated virus isolate hu.29 capsid protein VP1 (cap) gene, complete cds, dated Jun. 24, 2004, 2 pages.
Genbank Accession No. AY530595, Adeno-associated virus isolate hu.3 capsid protein VP1 (cap) gene, complete cds, dated Jun. 24, 2004, 2 pages.
Genbank Accession No. AY530596, Adeno-associated virus isolate hu.31 capsid protein VP1 (cap) gene, complete cds, dated Jun. 24, 2004, 2 pages.
Genbank Accession No. AY530597, Adeno-associated virus isolate hu.32 capsid protein VP1 (cap) gene, complete cds, dated Jun. 24, 2004, 2 pages.
Genbank Accession No. AY530598, Adeno-associated virus isolate hu.34 capsid protein VP1 (cap) gene, complete cds, dated Jun. 24, 2004, 2 pages.
Genbank Accession No. AY530599, Adeno-associated virus isolate hu.35 capsid protein VP1 (cap) gene, complete cds, dated Jun. 24, 2004, 2 pages.
Genbank Accession No. AY530600, Adeno-associated virus isolate hu.37 capsid protein VP1 (cap) gene, complete cds, dated Jun. 24, 2004, 2 pages.
Genbank Accession No. AY530601, Adeno-associated virus isolate hu.39 capsid protein VP1 (cap) gene, complete cds, dated Jun. 24, 2004, 2 pages.
Genbank Accession No. AY530602, Adeno-associated virus isolate hu.4 capsid protein VP1 (cap) gene, complete cds, dated Jun. 24, 2004, 2 pages.
Genbank Accession No. AY530603, Adeno-associated virus isolate hu.40 capsid protein VP1 (cap) gene, complete cds, dated Jun. 24, 2004, 2 pages.
Genbank Accession No. AY530604, Adeno-associated virus isolate hu.41 capsid protein VP1 (cap) gene, complete cds, dated Jun. 24, 2004, 2 pages.
Genbank Accession No. AY530605, Adeno-associated virus isolate hu.42 capsid protein VP1 (cap) gene, complete cds, dated Jun. 24, 2004, 2 pages.
Genbank Accession No. AY530606, Adeno-associated virus isolate hu.43 capsid protein VP1 (cap) gene, complete cds, dated Jun. 24, 2004, 2 pages.
Genbank Accession No. AY530607, Adeno-associated virus isolate hu.44 capsid protein VP1 (cap) gene, complete cds, dated Jun. 24, 2004, 2 pages.
Genbank Accession No. AY530608, Adeno-associated virus isolate hu.45 capsid protein VP1 (cap) gene, complete cds, dated Jun. 24, 2004, 2 pages.
Genbank Accession No. AY530609, Adeno-associated virus isolate hu.46 capsid protein VP1 (cap) gene, complete cds, dated Jun. 24, 2004, 2 pages.
Genbank Accession No. AY530610, Adeno-associated virus isolate hu.47 capsid protein VP1 (cap) gene, complete cds, dated Jun. 24, 2004, 2 pages.
Genbank Accession No. AY530611, Adeno-associated virus isolate hu.48 capsid protein VP1 (cap) gene, complete cds, dated Jun. 24, 2004, 4 pages.
Genbank Accession No. AY530612, Adeno-associated virus isolate hu.49 capsid protein VP1 (cap) gene, complete cds, dated Jun. 24, 2004, 2 pages.
Genbank Accession No. AY530613, Adeno-associated virus isolate hu.51 capsid protein VP1 (cap) gene, complete cds, dated Jun. 24, 2004, 2 pages.
Genbank Accession No. AY530614, Adeno-associated virus isolate hu.52 capsid protein VP1 (cap) gene, complete cds, dated Jun. 24, 2004, 2 pages.
Genbank Accession No. AY530615, Adeno-associated virus isolate hu.53 capsid protein VP1 (cap) gene, complete cds, dated Jun. 24, 2004, 2 pages.
Genbank Accession No. AY530616, Adeno-associated virus isolate hu.54 capsid protein VP1 (cap) gene, complete cds, dated Jun. 24, 2004, 2 pages.
Genbank Accession No. AY530617, Adeno-associated virus isolate hu.55 capsid protein VP1 (cap) gene, complete cds, dated Jun. 24, 2004, 2 pages.
Genbank Accession No. AY530618, Adeno-associated virus isolate hu.56 capsid protein VP1 (cap) gene, complete cds, dated Jun. 24, 2004, 2 pages.

(56) References Cited

OTHER PUBLICATIONS

Genbank Accession No. AY530619, Adeno-associated virus isolate hu.57 capsid protein VP1 (cap) gene, complete cds, dated Jun. 24, 2004, 2 pages.
Genbank Accession No. AY530620, Adeno-associated virus isolate hu.58 capsid protein VP1 (cap) gene, complete cds, dated Jun. 24, 2004, 2 pages.
Genbank Accession No. AY530621, Adeno-associated virus isolate hu.6 capsid protein VP1 (cap) gene, complete cds, dated Jun. 24, 2004, 2 pages.
Genbank Accession No. AY530622, Adeno-associated virus isolate hu.60 capsid protein VP1 (cap) gene, complete cds, dated Jun. 24, 2004, 2 pages.
Genbank Accession No. AY530623, Adeno-associated virus isolate hu.61 capsid protein VP1 (cap) gene, complete cds, dated Jun. 24, 2004, 2 pages.
Genbank Accession No. AY530624, Adeno-associated virus isolate hu.63 capsid protein VP1 (cap) gene, complete cds, dated Jun. 24, 2004, 2 pages.
Genbank Accession No. AY530625, Adeno-associated virus isolate hu.64 capsid protein VP1 (cap) gene, complete cds, dated Jun. 24, 2004, 2 pages.
Genbank Accession No. AY530626, Adeno-associated virus isolate hu.66 capsid protein VP1 (cap) gene, complete cds, dated Jun. 24, 2004, 2 pages.
Genbank Accession No. AY530627, Adeno-associated virus isolate hu.67 capsid protein VP1 (cap) gene, complete cds, dated Jun. 24, 2004, 2 pages.
Genbank Accession No. AY530628, Adeno-associated virus isolate hu.7 capsid protein VP1 (cap) gene, complete cds, dated Jun. 24, 2004, 2 pages.
Genbank Accession No. AY530629, Adeno-associated virus isolate hu.9 capsid protein VP1 (cap) gene, complete cds, dated Jun. 24, 2004, 2 pages.
Genbank Accession No. AY629583, Avian adeno-associated virus strain DA-1, complete genome, dated Sep. 10, 2004, 3 pages.
Genbank Accession No. AY631966, Adeno-associated virus 11 nonstructural protein and capsid protein genes, complete cds, dated Nov. 30, 2004, 3 pages.
Genbank Accession No. AY695370, Adeno-associated virus isolate hu.T17 capsid protein VP1 (cap) gene, complete cds, dated Nov. 15, 2005, 3 pages.
Genbank Accession No. AY695371, Adeno-associated virus isolate hu. T32 Rep 78 protein and capsid protein VP1 (cap) genes, complete cds, dated Nov. 15, 2005, 3 pages.
Genbank Accession No. AY695372, Adeno-associated virus isolate hu.T40 Rep 78 protein and capsid protein VP1 (cap) genes, complete cds, dated Nov. 15, 2005, 3 pages.
Genbank Accession No. AY695373, Adeno-associated virus isolate hu. T70 Rep 78 protein and capsid protein VP1 (cap) genes, complete cds, dated Nov. 15, 2005, 3 pages.
Genbank Accession No. AY695374, Adeno-associated virus isolate hu.T32 Rep 71 protein and capsid protein VP1 (cap) genes, complete cds, dated Nov. 15, 2005, 3 pages.
Genbank Accession No. AY695375, Adeno-associated virus isolate hu. T88 Rep 78 protein and capsid protein VP1 (cap) genes, complete cds, dated Nov. 15, 2005, 3 pages.
Genbank Accession No. AY695376, Adeno-associated virus isolate hu.S17 Rep 78 protein and capsid protein VP1 (cap) genes, complete cds, dated Nov. 15, 2005, 3 pages.
Genbank Accession No. AY695377, Adeno-associated virus isolate hu.LG15 capsid protein VP1 (cap) gene, complete cds, dated Nov. 15, 2005, 3 pages.
Genbank Accession No. AY695378, Adeno-associated virus isolate hu.T41 capsid protein VP1 (cap) gene, complete cds, dated Nov. 15, 2005, 2 pages.
GenBank Accession No. BC045895 'Dania rerio Niemann-Pick disease, type C2, mRNA (cDNA clone MGC:56070 IMAGE:5409780), complete eds' (2003).
GenBank Accession No. BC054539 'Mus musculus Niemann Pick type C1, mRNA (cDNA clone MGC:62352 IMAGE:6405214), complete eds' (2006).
GenBank Accession No. BC090541 'Dania rerio Niemann-Pick disease, type C1, mRNA (cDNA clone IMAGE:7149020), partial eds' (2016).
GenBank Accession No. BC102504 'Bos taurus Niemann-Pick disease, type C2, mRNA (cDNA clone MGC: 127986 IMAGE:7954223), complete eds' (2007).
GenBank Accession No. BC117178 '*Homo sapiens* NPC1 (Niemann-Pick disease, type C1, gene)-like 1, mRNA (cDNA clone MGC:150787 IMAGE:40125729), complete eds' (2006).
GenBank Accession No. BC143756 '*Homo sapiens* NPC1 (Niemann-Pick disease, type C1, gene)-like 1, mRNA (cDNA clone MGC:177287 IMAGE:9052270), complete eds' (2009).
GenBank Accession No. BC151276 'Bos taurus Niemann-Pick disease, type C1, mRNA (cDNA clone MGC: 152602 IMAGE:8433293), complete eds '(2007).
Genbank Accession No. DQ813647, Adeno-Associated Virus 12 Rep 78 and VP1 genes, complete cds., dated Feb. 20, 2008, 3 pages.
GenBank Accession No. J00306 "Human somatostatin I gene and flanks" NCBJ (2 pages). (Jan. 13, 1995).
GenBank Accession No. J01901 "adeno-associated Virus 2, complete genome" NCBJ (3 paqes). (Apr. 27, 1993).
GenBank Accession No. J02275 "Minute Virus of mice, complete genome" NCBJ (4 pages). (May 22, 1995).
GenBank Accession No. KJ893081 'Synthetic construct *Homo sapiens* clone ccsbBroadEn 02475 NPC2 qene, encodes complete protein' (2015).
Genbank Accession No. MI332400.1, Sequence 20 from U.S. Pat. No. 9,839,696, dated Feb. 12, 2018, 2 pages.
Genbank Accession No. MI332401.1, Sequence 21 from U.S. Pat. No. 9,839,696, dated Feb. 12, 2018, 2 pages.
Genbank Accession No. MI332402.1, Sequence 22 from U.S. Pat. No. 9,839,696, dated Feb. 12, 2018, 2 pages.
Genbank Accession No. MI332403.1, Sequence 23 from U.S. Pat. No. 9,839,696, dated Feb. 12, 2018, 2 pages.
Genbank Accession No. MI332404.1, Sequence 24 from U.S. Pat. No. 9,839,696, 9,839,696, dated Feb. 12, 2018, 2 pages.
Genbank Accession No. MI332405.1, Sequence 25 from U.S. Pat. No. 9,839,696, 9,839,696, dated Feb. 12, 2018, 2 pages.
Genbank Accession No. MI332406.1, Sequence 26 from U.S. Pat. No. 9,839,696, dated Feb. 12, 2018, 2 pages.
Genbank Accession No. MI332407.1, Sequence 27 from U.S. Pat. No. 9,839,696, 9,839,696, dated Feb. 12, 2018, 2 pages.
Genbank Accession No. MI332408.1, Sequence 28 from U.S. Pat. No. 9,839,696, dated Feb. 12, 2018, 2 pages.
Genbank Accession No. MI332409.1, Sequence 29 from U.S. Pat. No. 9,839,696, dated Feb. 12, 2018, 2 pages.
Genbank Accession No. MI332410.1, Sequence 30 from U.S. Pat. No. 9,839,696, dated Feb. 12, 2018, 2 pages.
Genbank Accession No. MI332411.1, Sequence 31 from U.S. Pat. No. 9,839,696, dated Feb. 12, 2018, 2 pages.
Genbank Accession No. MI332412.1, Sequence 32 from U.S. Pat. No. 9,839,696, dated Feb. 12, 2018, 2 pages.
Genbank Accession No. MI332413.1, Sequence 33 from U.S. Pat. No. 9,839,696, dated Feb. 12, 2018, 2 pages.
Genbank Accession No. MI332414.1, Sequence 34 from U.S. Pat. No. 9,839,696, dated Feb. 12, 2018, 2 pages.
Genbank Accession No. MI332415.1, Sequence 35 from U.S. Pat. No. 9,839,696, dated Feb. 12, 2018, 2 pages.
GenBank Accession No. NC_000883 "Human parvoVirus 819, complete genome" NCBI (4 pages). (Feb. 10, 2015).
GenBank Accession No. NC_001358 "ParvoVirus H1, complete genome" NCBI (3 pages). (Feb. 10, 2015).
GenBank Accession No. NC_001401 "adeno-associated Virus—2, complete genome" NCBI (5 pages). (Dec. 2, 2014).
GenBank Accession No. NC_001510 "Minute Virus of mice, complete genome" NCBI (5 pages). (Mar. 28, 2016).
GenBank Accession No. NC_001701 "Goose parvovir, complete genome" NCBI (4 pages). (Jan. 28, 2010).
GenBank Accession No. NC_001729 "adeno-associated vir—3, complete genome" NCBI (3 pages). (Jun. 28, 2010).

(56) References Cited

OTHER PUBLICATIONS

Genbank Accession No. NC_001729, Adeno-associated virus—3, complete genome, dated Aug. 13, 2018, 3 pages.
Genbank Accession No. NC_001829, Adeno-associated virus—4, complete genome, dated Aug. 13, 2018, 3 pages.
GenBank Accession No. NC_001862 "adeno-associated Virus 6, complete genome" NCBJ (3 pages). (Jan. 12, 2004).
Genbank Accession No. NC_001863, Adeno-associated virus 3B, complete genome, dated Jan. 12, 2004, 4 pages.
GenBank Accession No. NC_002077 "adeno-associated Virus—1, complete genome" NCBI (3 pages). (Mar. 11, 2010).
Genbank Accession No. NC_004828, Avian adeno-associated virus Atcc VR-865, complete genome, dated Aug. 13, 2018, 3 pages.
Genbank Accession No. NC_005889, Bovine adeno-associated virus, complete genome, dated Aug. 13, 2018, 3 pages.
Genbank Accession No. NC_006148.1, Snake parvovirus 1, complete genome, dated Aug. 13, 2018, 3 pages.
GenBank Accession No. NC_006152 "adeno-associated Virus 5, complete genome" NCBI (3 pages). (Dec. 8, 2008).
GenBank Accession No. NC_006261 "adeno-associated Virus—8, complete genome" NCBI (3 pages). (Mar. 11, 2010).
Genbank Accession No. NC_006263, Avian adeno-associated virus strain DA-1, complete genome, dated Aug. 13, 2018, 3 pages.
GenBank Accession No. NM 008720.2 'Mus musculus cholesterol transporter 1 (Npc1), mRNA' (2017).
GenBank Accession No. NM 023409.4 'Mus musculus NPC intracellular cholesterol transporter 2 (Npc2 mRNA' (2017).
GenBank Accession No. NM 173918 Bos taurus NPC intracellular cholesterol transporter 2 (NPC2), mRNA-;-(2017).
GenBank Accession No. NM_006432.3 'Homo sapiens NPC intracellular cholesterol transporter 2 (NPC2), mRNA' (2017).
GenBank Accession No. NM_214206 "Sus scrofa NPC intracellular cholesterol transporter 2 (NPC2), mRNA," dated Jun. 20, 2021, 2 pages.
GenBank Accession No. NP_044927 "capsid [Adeno-associated Virus—4]" NCBI (2 pages). (Jan. 28, 2010).
GenBank Accession No. P01166 "Somatostatin precursor [Contains-:Somatostatin 28; Somatostatin-14]" NCBI (2 pages). (Sep. 15, 2003).
GenBank Accession No. P61278 "Somatostatin precursor [Contains: Somatostatin 28; Somatostatin-14]" NCBI (2 pages). (Nov. 13, 2019).
GenBank Accession No. X01457 "ParvoVirus h-1, complete genome" NCBI (3 pages). (Apr. 18, 2005).
Genbank Accession No. Y18065, adeno-associated virus type 5 partial genome (cap and rep genes complete), dated Jan. 15, 1999, 3 pages.
Genbank Accession No. NC_002077, Adeno-associated virus—1, dated Aug. 13, 2018, 3 pages.
GenBank Accession No. BC002532 'Homo sapiens Niemann-Pick disease, type C2, mRNA (cDNA clone MGC:1333 IMAGE:3140870), complete eds' (2006).
GenBank Accession No. NC_001540 "Bovine parvovir, complete genome" NCBI (4 pages). (Nov. 30, 2009).
Gonzales, "Cross-Species Evolution of Synthetic AAV Strains for clinical Translation," ASGCT, 23 pages. (2020).
Gorman et al. "Stable alteration of pre-mRNA splicing patterns by modified U7 small nuclear RNAs" Proceedings of the National Academy of Sciences 95:4929:4934 (1998).
Govindasamy et al., "Structural Insights into Adeno-Associated Virus Serotype 5," J. Virology 87: 11187-11199 (2013).
Govindasamy et al., "Structurally mapping the diverse phenotype of adeno-associated virus serotype 4," J. Virol 80:11556-11570 (2006).
Gray et al. "Preclinical Differences of Intravascular MV9 Delivery to Neurons and Glia: A Comparative Study of Adult Mice and Nonhuman Primates" Molecular Therapy, 19(6):1058-1069 (2011).
Gregorevic et al. "Systemic Microdystrophin Gene Delivery Improves Skeletal Muscle Structure and Function in Old Dystrophic mdx Mice" Molecular Therapy 16(4):657-664 (2008).

Grieger, et al., "Separate Basic Region Motifs within the Adena-Associated Virus Capsid Proteins Are Essential for Infectivity and Assembly." J. Viral. (2006), 80(11): 5199-5210.
Grifman, et al., "Incorporation of tumor-targeting peptides into recombinant adeno-associated virus capsids". Molecular Therapy (2001); vol. 3, No. 6, pp. 964-975.
Grimm et al., "In vitro and in vivo gene therapy vector evolution via multispecies interbreeding and retargeting of adeno-associated vires," Journal of Virology, The American Society for Microbiology, 82(12):5887-5911 (2008).
Gurda et al. "Capsid Antibodies to Different adeno-Associated Virus Serotypes Bind Common Regions" Journal of Virology, 87(16):9111-9124 (2013).
Gurda et al., "Mapping a Neutralizing Epitope onto the Capsid of Adeno—Associated Virus Serotype 8," Journal of Virology 86(15): 7739-7751 (2012).
Hadaczek et al. "Transduction of Nonhuman Primate Brain with Adeno-Associated Virus Serotype 1: Vector Trafficking and Immune Response" Human Gene Therapy, 20(3):225-237 (2009).
Hajitou et al., "Vascular targeting: recent advances and therapeutic perspectives," TCM 16:80-88 (2006).
Hauck et al. "Characterization of Tissue Tropism Determinants of Adeno-Associated Virus Type 1" Journal of Virology 77(4):2768-2774 (2003).
Havlik, Engineering A Humanized AAV8 Capsid Through Iterative Structure-Guided Evolution ASGCT, 24 pages. (2019).
Higgins, Desmond G., and Sharp, Paul M. "CLUSTAL: a package for performing multiple sequence alignment on a microcomputer." Gene (1988); 73.1: 237-244.
Hoshijima et al. "Chronic suppression of heart-failure progression by a pseudophosphorylated mutant of phospholamban via in vivo cardiac rAAV gene delivery" Nature Medicine 8:864-871 (2002).
Huang et al. "Characterization of the adeno-Associated Virus 1 and 6 Sialic Acid Binding Site" Journal of Virology, 9 (11):5219-5230 (2016).
Huang et al. "ParvoVirus qlycan interactions" Current Opinion in Virology 7:108-118 (2014).
Huang, X et al., 'Dynamic programming algorithms for restriction map comparison,' Cabios, Vo1.8, No. 5., pp. 511-520, (1992).
Hughes et al., "AAV9 intracerebroventricular gene therapy improves lifespan, locomotor function and pathology in a mouse model of Niemann-Pick type C1 disease," Human Molecular Genetics 27(17)3079-3098 (2018).
International Search Report and the Written Opinion of the International Searching Authority corresponding to International Patent Application No. PCT/2018/018381 (14 pages) (mailed Jul. 5, 2018).
International Search Report and the Written Opinion of the International Searching Authority corresponding to International Patent Application No. PCT/US2019/020053 (10 pages) (mailed Jun. 6, 2019).
International Search Report and Written Opinion issued by the International Searching Authority for Application No. PCT/US2020/056015, dated Feb. 12, 2021, 17 pages.
International Search Report and Written Opinion issued by the International Searching Authority for Application No. PCT/US2020/056031, dated Feb. 15, 2021, 18 pages.
International Search Report and Written Opinion issued by the International Searching Authority for Application No. PCT/2016/013460, dated May 12, 2016, 11 pages.
International Search Report and Written Opinion issued by the International Searching Authority for Application No. PCT/2016/054143, dated Mar. 23, 2017, 33 pages.
International Search Report and Written Opinion issued by the International Searching Authority for Application No. PCT/2020/023877, dated Aug. 3, 2020, 21 pages.
International Search Report and Written Opinion issued by the International Searching Authority for Application No. PCT/US2016/026524, dated Jan. 9, 2016, 10 pages.
International Search Report and Written Opinion issued by the International Searching Authority for Application No. PCT/US2018/038584 dated Aug. 24, 2018, 11 pages.

(56) References Cited

OTHER PUBLICATIONS

International Search Report and Written Opinion issued by the International Searching Authority for Application No. PCT/US2019/062531, dated Apr. 1, 2020, 12 pages.
International Search Report and Written Opinion issued by the International Searching Authority for Application No. PCT/US2020/032978, dated Oct. 15, 2020, 14 pages.
International Search Report of International PCT/US2016/026524, mailed Sep. 1, 2016.
Janson, C. et al., 'Clinical protocol. Gene therapy of Canavan disease: AAV-2 vector for neurosurgical delivery of aspartoacylase gene (ASPA) to the human brain,' Hum. Gene Ther., 13(11):1391-1412 (Jul. 2002).
Kailasan et al., "Structure of an enteric pathogen, bovine parvovirus," Virology 89:2603-2614 (2015).
Kaplitt, M.G. et al. (1994). "Long-term gene expression and phenotypic correction using adeno-associated virus vectors in the mammalian brain," Nature Genetics 6:148-154.
Karlin et al. "Applications and statistics for multiple high-scoring segments in molecular sequences" Proceedings of National Academy of Sciences 90:5873-5877 (1993).
Kashiwakura et al. "Hepatocyte Growth Factor Receptor Is a Coreceptor for Adeno- Associated Virus Type 2 Infection" Journal of Virology, 79(1).609-614 (2005).
Kauffman et al., "Mechanism Matters: A Taxonomy of Cell Penetrating Peptides," Trends in Biochemcial Sciences, Elsevier, Amsterdam, NL 40(12):749-764 (2015).
Kawakami et al. "Cloning of the gene coding for a shared human melanoma antigen recognized by autologo T cells infiltrating into tumor" Proceedings of the National Academy of Sciences 91:3515-3519 (1994).
Kawakami et al. "Identification of the Immunodominant Peptides of the MART-1 Human Melanoma Antigen Recognized by the Majority of HLA-A2-restricted Tumor Infiltrating Lymphocytes" The Journal of Experimental Medicine 180:347-352 (1994).
Koivunen et al., "Identification of Receptor Ligands with Phase Display Peptide Libraries," J. Nucl. Med. 40:883-888 (1999).
Krissinel et al. "Secondary-structure matching (SSM)., a new tool for fast protein structure alignment in three dimensions" Acta Crystallographica Section D: Biological Crystallography, D60:2256-2268 (2004).
Kumar et al. "MEGA?: Molecular Evolutionary Genetics Analysis Version 7.0 for Bigger Datasets" Molecular Biology and Evolution, 33(7):1870-1874 (2016).
Lein et al. "Genome-wide atlas of gene expression in the adult mouse brain" Nature, 445(7124):168-176 (2007). (Abstract only).
Lerch et al, "The structure of adeno-associated virus serotype 3B (AAV-3B): insights into receptor binding and immune evasion," Virology 403(1):26-36 (2010).
Levine et al. "The Tumor Suppressor Genes" Annual Review of Biochemistry 62:623-651 (1993).
Li et al. "Construction of phospholamban antisense RNA recombinant adeno-associated Virus vector and its effects in rat cardiomyocytes" Acta Pharmalogica Sinica 26(1).51-55 (2005).
Li et al. "Development of Patient-specific AAV Vectors After Neutralizing Antibody Selection for Enhanced Muscle Gene Transfer" Molecular Therapy, 24(1):53-65 (2016).
Li et al. "Engineering and Selection of Shuffled AAV Genomes: A New Strategy for Producing Targeted Biological Nanoparticles" Molecular Therapy, 16(7):1252-1260 (2008).
Li et al. "Single Amino Acid Modification of adeno-Associated Virus Capsid Changes Transduction and Humeral Immune Profiles" Journal of Virology, 86(15):7752-7759 (2012).
Lisowski et al., "Selection and evaluation of clinically relevant AAV variants in a xenograft liver model," Nature 506(7488):A73382-386 (2014).
Loftus, SK et al., 'Murine Model of Niemann-Pick C Disease: Mutation in a Cholesterol Homeostasis Gene,' Science, 277(5323):232-235 (Jul. 1997).
Madigan et al. "Engineering AAV receptor footprints for gene therapy" Current Opinion in Virology, 18:89-96 (2016).
Margolskee, R. F. "Epstein-Barr Virus Based Expression Vectors" Current Topics in Microbiology and Immunology 158:67-95 (1992).
Mauro et al., "A critical analysis of codon optimization in human therapeutics," Trends in Molecular Medicine, Nov. 2014, vol. 20, No. 11, pp. 604-613.
McCarty, D.M., et al., "Self-complementary recombinant adeno-associated virus (scAAV) vectors promote efficient transduction independently of DNA synthesis," Gene Therapy 8, 1248-1254 (2001).
McLaughlin et al., "Adeno-associated virus general transduction vectors: analysis of proviral structures," J. Virol., (1988) 62:1963-1973.
Miller et al. "Production, purification and preliminary X-ray crystallographic studies of adeno-associated virus serotype 1" Acta Crystallographica Section F: Structural Biology and Crystallization Communications, 62(Pt 12):1271-1274 (2006).
Mingozzi et al., "Overcoming the Host Immune Response to Adeno—Associated Virus Gene Delivery Vectors: The Race Between Clearance, Tolerance, Neutralization, and Escape," Annual Review of Virology 1(1):511-534 (2017).
Muller et al. "Random peptide libraries displayed on adeno-associated virus to select for targeted gene therapy vectors", Nat Biotechnol, Sep. 2003; 21(9):1040-6. Epub Aug. 3, 2003.
Mori et al. "Two novel adeno-associated vires from cynomolg monkey:pseudotyping characterization of capsid protein" Virology 330:375-383 (2004).
Muramatsu et al. "Nucleotide Sequencing and Generation of an Infectious Clone of adeno-Associated Virus 3", Virology, 221(0367):208-217 (1996).
Murlidharan et al. "265. Polysialic Acid as a Novel Regulator of AAV Tropism in the Developing Brain" Molecular Therapy 23(Supplement 1):S106 (2015), 1 page.
Murlidharan et al. "Biology of adeno-associated viral vectors in the central nervous system" Frontiers in Molecular Neuroscience, 7(76):1-9 (2014).
Murlidharan et al. "CNS-restricted Transduction and CRISPR/Cas9-mediated Gene Deletion with an Engineered AAV Vector" Molecular Therapy: Nucleic Acids, 5:e338 (2016).
Murlidharan et al. "Glymphatic fluid transport controls paravascular clearance of MV vectors from the brain" JCI Insight, 1(14):e88034 (2016).
Murlidharan et al. "Unique Glycan Signatures Regulate adeno-Associated Virus Tropism in the Developing Brain" Journal of Virology 89(7):3976-3987 (2015).
Muzyczka, N. "Use of adeno-Associated Virus as a General Transduction Vector for Mammalian Cells," Current Topics in Microbiology and Immunology 158:97-129 (1992).
Nam et al. "Structure of Adeno-Associated Virus Serotype 8, a Gene Therapy Vector" Journal of Virology, 81 (22):12260-12271 (2007).
Nathwani et al. "Long-Term Safety and Efficacy of Factor IX Gene Therapy in Hemophilia B" The New England Journal of Medicine, 371(21):1994-2004 (2014).
Needleman and Wunsch, "A general method applicable to the search for similarities in the amino acid sequence of two proteins." J Mol Biol. (1970); 48(3): 443-453.
Newton & Deutscher, Phage Peptide Display in Handbook of Experimental Pharmacology, pp. 145-163, Springer-Verlag, Berlin (2008).
Ng et al. "Structural Characterization of the Dual Glycan Binding adeno-Associated Virus Serotype 6" Journal of Virology, 84(24):12945-12957 (2010).
Nguyen Vu et al., "Cerebellar Purkinje cell activity drives motor learning", Nature Neuroscience 16(12):1734-1736 (2013).
International Search Report and Written Opinion issued by the International Searching Authority for Application No. PCT/US20/15386, dated Apr. 27, 2020, 14 pages.
Padron et al. "Structure of adeno-Associated Virus Type 4" Journal of Virology 79(8):5047-5058 (2005).
Palombo et al. "Site-Specific Integration in Mammalian Cells Mediated by a New Hybrid Baculovir-Adeno-Associated Virus Vector" Journal ofvirology72(6):5025-5034 (1998).

(56) References Cited

OTHER PUBLICATIONS

Papadakis, ED et al., 'Promoters and Control Elements: Designing Expression Cassettes for Gene Therapy,' Curr. Gene Therapy, vol. 4, No. 1, pp. 89-113, (Mar. 2004).
Partial Supplementary European Search Report issued by the European Patent Office for Application No. 16852471.8, dated Apr. 24, 2019, 17 pages.
Passini, MA et al., 'Distribution of a Lysosomal Enzyme in the Adult Brain by Axonal Transport and by Cells of the Rostral Migratory Stream,' J. Neuroscience, 22(15):6437-6446 (Aug. 2002).
Paul, CA et al., 'Adenovirus Expressing an NPCI-GFP Fusion Gene Corrects Neuronal and Nonneuronal Defects Associated With Niemann Pick Type C Disease,' J. Neurosci. Res., vol. 81, No. 5, pp. 706-719 (Sep. 2005).
Pillay et al. "An essential receptor for adeno-associated virus infection" Nature, 530(7588):108-112 (2016).
Pulicherla et al. "Engineering Liver-detargeted AAV9 Vectors for Cardiac and Musculoskeletal Gene Transfer" Molecular Therapy, 19(6):1070-1078 (2011).
Puttaraju et al. "Spliceosome-mediated RNA trans-splicing as a tool for gene therapy" Nature Biotechnology 17:246-252 (1999).
Robbins et al. "Recognition of Tyrosinase by Tumor-infiltrating Lymphocytes from a Patient Responding to Immunotherapy" Cancer Research 54:3124-3126 (1994).
Rosenberg et al. "Comparative Efficacy and Safety of Multiple Routes of Direct CNS Administration of Adeno—Associated Virus Gene Transfer Vector Serotype rh.10 Expressing the Human Arylsulfatase A cDNA to Nonhuman Primates" Human Gene Therapy Clinical Development, 25(3):164-177 (2014).
Rosenberg "The Immunotherapy of Solid Cancers Based on Cloning the Genes Encoding Tumor-Rejection Antigens" Annual Review of Medicine 47:481-491 (1996).
Saitou, N. et al. (1987). "The neighbor-joining method: A new method for reconstructing phylogenetic trees," Mol. Biol. Evol. 4:406-425.
Salinas et al. "A hitchhiker's guide to the nervous system: the complex journey of viruses and toxins" Nature Reviews Microbiology, 8(9):645-655 (2010). (Abstract only).
Selot et al., "Developing Immunologically Inert Adeno-Associated Virus (AAV). Vectors for Gene Therapy: Possibilities and Limitations," Current Pharmaceutical Biotechnology, Bentham Science Publishers, NL 14(12).1072-1082 (2013).
Shade et al. "Nucleotide Sequence and Genome Organization of Human ParvoVirus B19 Isolated from the Serum of a Child during Aplastic Crisis" Journal of Virology 28(3):921-936 (1986).
Sharp et al. "RNA Interference" Science 287(5462):2431-2433 (2000).
Shen et al. "Engraftment of a Galactose Receptor Footprint onto adeno-associated Viral Capsids Improves Transduction Efficiency" The Journal of Biological Chemistry, 288(40):28814-28823 (2013).
Shen et al., Multiple Roles for Sialylated Glycans in Determining the Cardiopulmonary Tropism of Adeno-Associated Virus 4, Journal of Virology 87(24):13206-13213 (2013).
Shi et al. "Insertional Mutagenesis at Positions 520 and 584 of adeno-Associated Virus Type 2 (AAV2). Capsid Gene and Generation of AAV2 Vectors with Eliminated Heparin—Binding Ability and Introduced Novel Tropism" Human Gene Therapy 17:353-361 (2006).
Sirin S, Apgar JR, Bennett EM, Keating AE. AB-Bind: Antibody binding mutational database for computational affinity predictions. Protein Sci. Feb. 2016;25(2):393-409. Epub Nov. 6, 2015.
Smith et al, "Comparison of Biosequences", Advanced in Applied Mathematics, vol. 2, Issue 4, Dec. 1981, pp. 482-489.
Smith et al., "Structural Mapping of AAV9 Antigenic Sites and the Engineering of Immune Escape Variants," Molecular Therapy; 20th Annual Meeting of the American Society of Gene and Cell Therapy (ASGCT).; Washington, DC, A; May 10 -13, 2017, Nature Publishing Group, GB vol. 25, No. 5, Suppl 1 (2017).
Smith, TF et al., 'Identification of Common Molecular Subsequences,' Journal of Molecular Biology, 147:195-197, PMID 7265238. doi: 10.1016/0022-2836(81)90087-5, (1981).
Sonntag et al. "Adeno-Associated Virus Type 2 Capsids with Externalized VP1NP2 Trafficking Domains Are Generated prior to Passage through the Cytoplasm and Are Maintained until Uncoating Occurs in the Nucleus" Journal of Virology, 80(22):11040-11054 (2006).
Srivastava et al. "Nucleotide Sequence and Organization of the Adeno Associated Virus 2 Genome." Journal of Virology (1983); 45:2, p. 555-564.
Summerford et al. "Membrane-Associated Heparan Sulfate Proteoglycan Is a Receptor for adeno-Associated Virus Type 2 Virions" Journal of Virology, 72(2):1438-1445 (1998).
Tellez et al. "Characterization of Naturally-Occurring Humoral Immunity to AAV in Sheep" Plos One, 8(9):e75142 (2013).
Tinsley et al. "Amelioration of the dystrophic phenotype of mdx mice using a truncated utrophin transQene" Nature 384(6607):349-353 (1996).
Titeux et al., "SIN Retroviral Vectors Expressing COL7A1 Under Human Promoters for Ex Vivo Gene Therapy of Recessive Dystrophic Epidermolysis Bullosa," Mol. Ther., 2010 18:1509-1518.
Tsao et al. The Three-Dimensional Structure of Canine ParvoVirus and Its Functional Implications Science 251(5000):1456-1464 (1991).
Tse et al., "Strategies to Circumvent Humoral Immunity to Adeno-Associated Viral Vectors," Expert Opinion on Biological Therapy 15(6):845-855 (2015).
Tse et al., "Structure-guided evolution of antigenically distinct adeno-associated Virus variants for immune evasion", Proceedings of the National Academy of Sciences of The United States of America 114(24):E4812-E4821 (2017).
Tseng et al. "Adeno-Associated Virus Serotype 1 (AAV1).—and AAV5-Antibody Complex Structures Reveal Evolutionary Commonalities in ParvoVirus Antigenic Reactivity" Journal of Virology, 89(3):1794-1808 (2015).
Tseng et al. "Generation and characterization of anti-adeno-associated Virus serotype 8 (AAV8). and anti-AAV9 monoclonal antibodies" Journal of Virological Methods, 236:105-110 (2016).
Tseng et al. "Mapping the AAV capsid host antibody response toward the development of second generation gene delivery vectors" Frontiers in Immunology, 5(9):1-11 (2014).
UniProt Accession No. O15118, dated May 30, 2000, 21 pages.
Urabe et al. "Insect Cells as a Factory to Produce adeno-Associated Virus Type 2 Vectors" Human Gene Therapy 13:1935-1943 (2002).
Veldwijk, MR et al., 'Development and optimization of a real-time quantitative PCR-based method for the titration of AAV-2 vector stocks,' Mal. Ther.,6(2):272-8 (Aug. 2002).
Vincent et al. "Long-term correction of moe dystrophic degeneration by adenovir- mediated transfer of a minidystrophin gene" Nature Genetics 5:130-134 (1993).
Walters et al. "Structure of adeno-Associated Virus Serotype 5" Journal of Virology 78(7):3361-3371 (2004).
Wang et al. "Adeno-associated Virus vector carrying human minidystrophin genes effectively ameliorates muscular dystrophy in mdx mouse model" Proceedings of the National Academy of Sciences 97(25):13714-13719 (2000).
Wang et al., "Selection of neutralizing antibody-resistant AAV8 variants with structure-guided site-specific saturated mutagenesis," Molecular Therapy, 2011, vol. 19 Suppl. 1, S129.
Wang et al. "Expanding the genetic code" Annual Review of Biophysics and Biomolecular Structure 35:225-249 (2006).
Wassif, CA et al., 'High Incidence of Unrecognized Visceral/Neurological Lateonset Niemann-Pick Disease, type C1 Predicted by Analysis of Massively Parallel Sequencing Data Sets,' Genet Med., 18(1):41-48 (Jan. 2016).
Weller et al. "Epidermal growth factor receptor is a co-receptor for adeno-associated virus serotype 6" Nature Medicine, 16(6):662-664 (2010).
Williams et al. "Monocyte maturation, HIV susceptibility, and transmigration across the blood brain barrier are critical in HIV neuropathogenesis" Journal of Leukocyte Biology, 91(3):401-415 (2012).

(56) References Cited

OTHER PUBLICATIONS

Winkler et al., "Changing the Antigen Binding Specificity by Single Point Mutations of an Anti-p24 (HIV-1) Antibody", The Journal of Immunology, 165: 4505-4514 (2000).

Work, et al., "Vascular bed-targeted in vivo gene delivery using tropism-modified adeno-associated viruses." Mol. Ther.; vol. 13, No. 4, pp. 683-693 (Apr. 2006).

Wu et al. "alpha2,3 and alpha2,6 N-Linked Sialic Acids Facilitate Efficient Binding and Transduction by Adeno—Associated Virus Types 1 and 6" Journal of Virology, 80(18):9093-9103 (2006).

Wu et al. "Single Amino Acid Changes Can Influence Titer, Heparin Binding, and Tissue Tropism in Different adeno—Associated Virus Serotypes" Journal of Virology, 80(22):11393-11397 (2006).

Xiao et al. "Gene Therapy Vectors Based on adeno-Associated Virus Type 1" Journal of Virology 73(5):3994-4003 (1999).

Xiao et al., "Gene transfer by adeno-associated virus vectors into the central nervous system," Exp. Neurobiol., (1997) 144:113-124.

Xiao et al. "Interpretation of Electron Density with Stereographic Roadmap Projections" Journal of Structural Biology, 158(2):182-187 (2007).

Xie et al. "Canine ParvoVirus Capsid Structure, Analyzed at 2.9 A Resolution" Journal of Molecular Biology 264(3):497-420 (1996).

Xie et al. "The atomic structure of adeno-associated Virus (AAV-2)., a vector for human gene therapy" Proceeding of the National Academy of Sciences 99(16):10405-10410 (2002).

Xie, J. et al., "Short DNA Hairpins Compromise Recombinant Adeno-Associated Virus Genome Homogeneity," Mol. Ther., 25(6): 1363-1374 (2017).

Yang et al. "Global CNS Transduction of Adult Mice by Intravenously Delivered rAAVrh.8 and rAAVrh.10 and Nonhuman Primates by rAAVrh.10" Molecular Therapy, 22(7):1299-1309 (2014).

Zhang, "Endocytic mechanisms and drug discovery in neurodegenerative diseases," Frontiers in Bioscience 13:6086-6105 (2008).

Zhang et al. "Several rAAV Vectors Efficiently Cross the Blood-brain Barrier and Transduce Neurons and Astrocytes in the Neonatal Mouse Central Nervous System" Molecular Therapy, 19(8):1440-1448 (2011).

Zhang et al. "Recombinant adeno Virus expressing adeno-associated Virus cap and rep proteins supports production of high-titer recombinant adeno-associated vir" Gene Therapy 8:704-712 (2001).

Zinn, E. et al., "In Silico Reconstruction of the Viral Evolutionary Lineage Yields a Potent Gene Therapy Vector," Cell Reports, Aug. 2015; 12:1056-1068.

Zolotukhin, et al., "Recombinant adeno-associated virus purification using novel methods improves infectious titer and yield." Gene Therapy (1999); vol. 6, pp. 973-985.

\* cited by examiner

VIRUS VECTORS FOR TARGETING OPHTHALMIC TISSUES

CROSS REFERENCE TO RELATED APPLICATIONS

This application is a national phase of International Application No. PCT/US2019/025584, filed Apr. 3, 2019, which claims priority to U.S. Provisional Application Ser. No. 62/652,108, filed Apr. 3, 2018 each of which is incorporated by reference herein in its entirety for all purposes.

FIELD OF THE DISCLOSURE

The present disclosure relates to modified capsid proteins from adeno-associated virus (AAV) and virus capsids and virus vectors comprising the same. In particular, the disclosure relates to modified AAV capsid proteins and capsids comprising the same that can be incorporated into viral vectors to confer a desirable transduction profile with respect to a target tissue(s) of interest, such as an ophthalmic tissue.

SEQUENCE LISTING

The instant application contains a Sequence Listing which has been submitted electronically in ASCII format and is hereby incorporated by reference in its entirety. Said ASCII copy, created on Oct. 2, 2020, is named STRD_007_01US_SeqList_ST25.txt and is about 652 kb in size.

BACKGROUND

New adeno-associated virus (AAV) strains isolated from animal tissues and adenoviral stocks have expanded the panel of AAV vectors available for therapeutic gene transfer applications. Comprehensive efforts to map tissue tropisms of these AAV isolates in animal models are currently underway. The ability to direct homing of AAV vectors to selective organs is useful for gene therapy and other therapeutic applications.

Gene therapy shows promise for treating ophthalmic diseases, and it has been shown that AAV is capable of transducing multiple cell types and cell layers in the eye. The compositions and methods provided herein address a need in the art for nucleic acid delivery vectors with desirable targeting features, such as targeting to specific regions of the eye (e.g., the retinal pigment epithelium (RPE) or retina).

BRIEF SUMMARY

Provided herein are AAV capsid proteins and AAV viral vectors that specifically target and infect one or more tissues of interest, such as tissues of the eye (e.g., the RPE or retina). In some embodiments, the present disclosure provides a recombinant adeno-associated virus (AAV) capsid protein comprising one or more amino acid substitutions, wherein the one or more amino acid substitutions modify one or more surface-exposed loops on the AAV capsid protein. In some embodiments, the modification of the one or more surface-exposed loops results in an enhanced transduction profile with respect to a target tissue. In embodiments, when the AAV capsid protein is incorporated into an AAV vector, the modification of the one or more surface-exposed loops results in enhanced transduction to an ophthalmic tissue. In some embodiments, when the AAV capsid protein incorporated into an AAV vector, the modification of the one or more surface-exposed loops results in enhanced transduction to the retinal pigment epithelium (RPE) and/or the retina as compared to a parental capsid which does not comprise the modification.

In some embodiments, the present disclosure provides a recombinant AAV capsid protein, wherein the capsid protein comprises a substitution in a surface-exposed loop of the AAV capsid protein, wherein the substitution has a sequence of any one of SEQ ID NO: 14, 15, 16, 17, 18, 19, 20, 21, 22, 187, 188, 189, 190, 191, 192, 193, and 194. In some embodiments, the recombinant AAV capsid comprises an amino acid sequence with at least 80% sequence identity to a capsid protein of any one of AAV1, AAV2, AAV3, AAV4, AAV5, AAV6, AAV7, AAV8, AAV9, AAV10, AAV11, AAV12, AAVrh.8, AAVrh.10, AAVrh32.33, AAVrh74, bovine AAV and avian AAV. In some embodiments, the recombinant AAV capsid protein comprises an amino acid sequence that has at least 90% sequence identity, with any one of SEQ ID NO: 11-12, 23-49, or 195-254.

In some embodiments, the disclosure provides an AAV capsid protein comprising an amino acid substitution, wherein the amino acid substitution replaces the amino acids in the region corresponding to amino acid positions 591-596 of SEQ ID NO. 11 or amino acids 590-595 of SEQ ID NO. 12.

In some embodiments, the disclosure provides a recombinant AAV capsid protein, wherein the capsid protein comprises a substitution comprising a sequence of six amino acids ($X^1$-$X^2$-$X^3$-$X^4$-$X^5$-$X^6$) that does not occur in the native AAV capsid protein, wherein $X^2$ is V and $X^5$ is L (SEQ ID NO:186). In some embodiments, the substitution is in a surface-exposed loop of the AAV capsid protein.

In some embodiments, the disclosure provides an AAV capsid protein, wherein the capsid protein comprises the amino acid sequence of any one of SEQ ID NO: 11-12, 23-49, or 195-254. In some embodiments the disclosure provides an AAV viral vector comprising an AAV capsid protein that comprises an amino acid sequence at least 90%, at least 95%, at least 96%, at least 97%, at least 98%, at least 99%, or 100% identical to the sequence of any one of SEQ ID NO: 11-12, 23-49, or 195-254. In some embodiments, the AAV viral vector specifically targets and infects the RPE and/or the retina. In some embodiments, the AAV viral vector demonstrates increased targeting and infection of the RPE and/or the retina as compared to a parental or wildtype AAV viral vector.

The present disclosure also provides a nucleotide sequence, or an expression vector comprising the same, that encodes one or more of the recombinant AAV capsid proteins of the disclosure. The present disclosure also provides a cell that comprises one or more nucleotide sequences or expression vectors of the disclosure.

The present disclosure also provides an AAV capsid comprising a recombinant AAV capsid protein of this disclosure. Further provided is a viral vector comprising a recombinant AAV capsid of this disclosure as well as a composition comprising a recombinant AAV capsid protein, AAV capsid and/or viral vector of this disclosure in a pharmaceutically acceptable carrier.

The present disclosure additionally provides a method of introducing a nucleic acid into a cell, comprising contacting the cell with the viral vector of this disclosure. The cell can be in a subject and in some embodiments, the subject can be a human subject.

In some embodiments, a method of treating a patient in need thereof is provided, the method comprising administering to the patient a therapeutically effective amount of an AAV viral vector of the disclosure.

These and other aspects are addressed in more detail in the detailed description set forth below.

BRIEF DESCRIPTION OF THE DRAWINGS

FIG. 2A and FIG. 2B show the same data as in FIG. 1A and FIG. 1B, respectively, but the data has been normalized to percent total reads, allowing for longitudinal comparison across subsequent rounds of evolution.

DETAILED DESCRIPTION

Figures 1A, 1B:
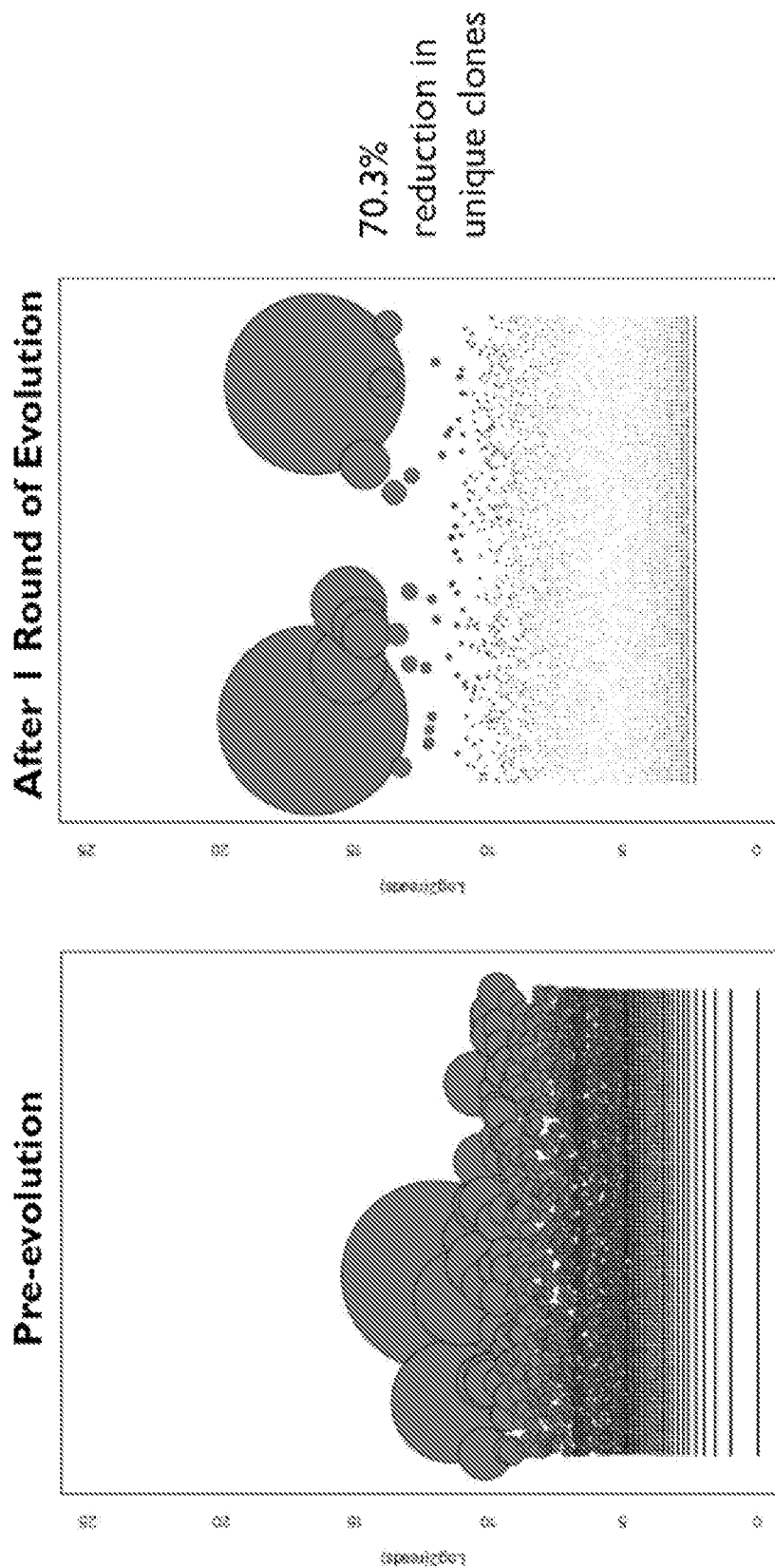
FIG. 1A and FIG. 1B. Bubble plots showing analysis of library diversity, directed evolution and enrichment of novel antigenic footprints. Parental (FIG. 1A) and evolved (FIG. 1B) libraries were subjected to high-throughput sequencing using the Illumina MiSeq platform. Following analysis with a custom Perl script, enriched amino acid sequences were plotted. Each bubble represents a distinct capsid amino acid sequence with the radius of the bubble proportional to the number of reads for that variant in the respective library. The y-axis represents the absolute number of reads, transformed to log base 2. Data are spread along the x-axis for ease of visualization. The percent reduction in unique clones (70.3%) directly demonstrates that numerous "un-fit" sequences were removed after a first round of evolution.

Unless otherwise defined, all technical and scientific terms used herein have the same meaning as commonly understood by one of ordinary skill in the art to which this disclosure belongs. The terminology used in the detailed description herein is for the purpose of describing particular embodiments only and is not intended to be limiting.

All publications, patent applications, patents, GenBank or other accession numbers and other references mentioned herein are incorporated by reference herein in their entirety.

The designation of all amino acid positions in the AAV capsid proteins in the disclosure and the appended claims is with respect to VP1 capsid subunit numbering. It will be understood by those skilled in the art that the modifications described herein if inserted into the AAV cap gene may result in modifications in the VP1, VP2 and/or VP3 capsid subunits. Alternatively, the capsid subunits can be expressed independently to achieve modification in only one or two of the capsid subunits (VP1, VP2, VP3, VP1+VP2, VP1+VP3, or VP2+VP3).

Definitions

The following terms are used in the description herein and the appended claims:

The singular forms "a," "an" and "the" are intended to include the plural forms as well, unless the context clearly indicates otherwise.

Furthermore, the term "about" as used herein when referring to a measurable value such as an amount of the length of a polynucleotide or polypeptide sequence, dose, time, temperature, and the like, is meant to encompass variations of ±20%, ±10%, ±5%, ±1%, ±0.5%, or even ±0.1% of the specified amount.

Also as used herein, "and/or" refers to and encompasses any and all possible combinations of one or more of the associated listed items, as well as the lack of combinations when interpreted in the alternative ("or").

Unless the context indicates otherwise, it is specifically intended that the various features described herein can be used in any combination.

Moreover, the present disclosure also contemplates that in some embodiments, any feature or combination of features set forth herein can be excluded or omitted. To illustrate further, if, for example, the specification indicates that a particular amino acid can be selected from A, G, I, L and/or V, this language also indicates that the amino acid can be selected from any subset of these amino acid(s) for example A, G, I or L; A, G, I or V; A or G; only L; etc., as if each such subcombination is expressly set forth herein. Moreover, such language also indicates that one or more of the specified amino acids can be disclaimed. For example, in particular embodiments the amino acid is not A, G or I; is not A; is not G or V; etc., as if each such possible disclaimer is expressly set forth herein.

As used herein, the terms "reduce," "reduces," "reduction" and similar terms mean a decrease of at least about 10%, about 15%, about 20%, about 25%, about 35%, about 50%, about 75%, about 80%, about 85%, about 90%, about 95%, about 97% or more.

As used herein, the terms "increase," "improve," "enhance," "enhances," "enhancement" and similar terms indicate an increase of at least about 10%, about 15%, about 20%, about 25%, about 50%, about 75%, about 100%, about 150%, about 200%, about 300%, about 400%, about 500% or more.

The term "parvovirus" as used herein encompasses the family Parvoviridae, including autonomously replicating parvoviruses and dependoviruses. The autonomous parvoviruses include members of the genera Protoparvovirus, Erythroparvovirus, Bocaparvovirus, and Densovirus subfamily. Exemplary autonomous parvoviruses include, but are not limited to, minute virus of mouse, bovine parvovirus, canine parvovirus, chicken parvovirus, feline panleukopenia virus, feline parvovirus, goose parvovirus, H1 parvovirus, muscovy duck parvovirus, B19 virus, and any other autonomous parvovirus now known or later discovered. Other autonomous parvoviruses are known to those skilled in the art. See, e.g., BERNARD N. FIELDS et al, VIROLOGY, volume 2, chapter 69 (4th ed., Lippincott-Raven Publishers; Cotmore et al. Archives of Virology DOI 10.1007/s00705-013-1914-1).

As used herein, the term "adeno-associated virus" (AAV), includes but is not limited to, AAV type 1, AAV type 2, AAV type 3 (including types 3A and 3B), AAV type 4, AAV type 5, AAV type 6, AAV type 7, AAV type 8, AAV type 9, AAV type 10, AAV type 11, AAV type 12, AAV type 13, AAV type rh32.33, AAV type rh8, AAV type rh10, AAV type rh74, AAV type hu.68, avian AAV, bovine AAV, canine AAV, equine AAV, ovine AAV, snake AAV, bearded dragon AAV, AAV2i8, AAV2g9, AAV-LK03, AAV7m8, AAV Anc80, AAV PHP. B, and any other AAV now known or later discovered. See, e.g., BERNARD N. FIELDS et al., VIROLOGY, volume 2, chapter 69 (4th ed., Lippincott-Raven Publishers). A number of AAV serotypes and clades have been identified (see, e.g., Gao et al, (2004) J. Virology 78:6381-6388; Moris et al, (2004) Virology 33-:375-383; and Table 2).

As used herein, the term "chimeric AAV" refers to an AAV comprising a capsid protein with regions, domains, individual amino acids that are derived from two or more different serotypes of AAV. In some embodiments, a chimeric AAV comprises a capsid protein comprised of a first region that is derived from a first AAV serotype and a second region that is derived from a second AAV serotype. In some embodiments, a chimeric AAV comprises a capsid protein comprised of a first region that is derived from a first AAV serotype, a second region that is derived from a second AAV serotype, and a third region that is derived from a third AAV serotype. In some embodiments, the chimeric AAV may comprise regions, domains, individual amino acids derived from two or more of AAV1, AAV2, AAV3, AAV4, AAV5, AAV6, AAV7, AAV8, AAV9, AAV10, AAV11, and/or AAV12. For example, the chimeric AAV may include regions, domains, and/or individual amino acids from a first and a second AAV serotype as shown below (Table 1), wherein AAVX+Y indicates a chimeric AAV including sequences derived from AAVX and AAVY.

The genomic sequences of various serotypes of AAV and the autonomous parvoviruses, as well as the sequences of the native terminal repeats (TRs), Rep proteins, and capsid subunits are known in the art. Such sequences may be found in the literature or in public databases such as GenBank. See, e.g., GenBank Accession Numbers NC_002077, NC_001401, NC_001729, NC_001863, NC_001829, NC_001 862, NC_000883, NC_001701, NC_001510, NC_006152, NC_006261, AF063497, U89790, AF043303, AF028705, AF028704, J02275, J01901, J02275, X01457, AF288061, AH009962, AY028226, AY028223, NC_001358, NC_001540, AF513851, AF513852, AY530579; the disclosures of which are incorporated by reference herein for teaching parvovirus and AAV nucleic acid and amino acid sequences. See also, e.g., Srivistava et al., (1983) J. Virology 45:555; Chiorini et al, (1998) J Virology 71:6823; Chiorini et al., (1999) J. Virology 73: 1309; Bantel-Schaal et al., (1999) J Virology 73:939; Xiao et al, (1999) J Virology 73:3994; Muramatsu et al., (1996) Virology 221:208; Shade et al, (1986) J. Virol. 58:921; Gao et al, (2002) Proc. Nat. Acad. Sci. USA 99:11854; Moris et al, (2004) Virology 33:375-383; international patent publications WO 00/28061, WO 99/61601, WO 98/11244; and U.S. Pat. No. 6,156,303; the disclosures of which are incorporated by reference herein for teaching parvovirus and AAV nucleic acid and amino acid sequences. See also Table 2. The capsid structures of autonomous parvoviruses and AAV are described in more detail in BERNARD N. FIELDS et al., VIROLOGY, volume 2, chapters 69 & 70 (4th ed., Lippincott-Raven Publishers). See also, description of the

TABLE 1

Chimeric AAVs

| | | | Second AAV Serotype | | | | | |
|---|---|---|---|---|---|---|---|---|
| | | AAV1 | AAV2 | AAV3 | AAV4 | AAV5 | AAV6 | AAV7 |
| First AAV Sertoype | AAV1 | x | AAV1 + 2 | AAV1 + 3 | AAV1 + 4 | AAV1 + 5 | AAV1 + 6 | AAV1 + 7 |
| | AAV2 | AAV2 + 1 | x | AAV2 + 3 | AAV2 + 4 | AAV2 + 5 | AAV2 + 6 | AAV2 + 7 |
| | AAV3 | AAV3 + 1 | AAV3 + 2 | x | AAV3 + 4 | AAV3 + 5 | AAV3 + 6 | AAV3 + 7 |
| | AAV4 | AAV4 + 1 | AAV4 + 2 | AAV4 + 3 | x | AAV4 + 5 | AAV4 + 6 | AAV4 + 7 |
| | AAV5 | AAV5 + 1 | AAV5 + 2 | AAV5 + 3 | AAV5 + 4 | x | AAV5 + 6 | AAV5 + 7 |
| | AAV6 | AAV6 + 1 | AAV6 + 2 | AAV6 + 3 | AAV6 + 4 | AAV6 + 5 | x | AAV6 + 7 |
| | AAV7 | AAV7 + 1 | AAV7 + 2 | AAV7 + 3 | AAV7 + 4 | AAV7 + 5 | AAV7 + 6 | x |
| | AAV8 | AAV8 + 1 | AAV8 + 2 | AAV8 + 3 | AAV8 + 4 | AAV8 + 5 | AAV8 + 6 | AAV8 + 7 |
| | AAV9 | AAV9 + 1 | AAV9 + 2 | AAV9 + 3 | AAV9 + 4 | AAV9 + 5 | AAV9 + 6 | AAV9 + 7 |
| | AAV10 | AAV10 + 1 | AAV10 + 2 | AAV10 + 3 | AAV10 + 4 | AAV10 + 5 | AAV10 + 6 | AAV10 + 7 |
| | AAV11 | AAV11 + 1 | AAV11 + 2 | AAV11 + 3 | AAV11 + 4 | AAV11 + 5 | AAV11 + 6 | AAV11 + 7 |
| | AAV12 | AAV12 + 1 | AAV12 + 2 | AAV12 + 3 | AAV12 + 4 | AAV12 + 5 | AAV12 + 6 | AAV12 + 7 |

| | | Second AAV Serotype | | | | |
|---|---|---|---|---|---|---|
| | | AAV8 | AAV9 | AAV10 | AAV11 | AAV12 |
| First AAV Sertoype | AAV1 | AAV1 + 8 | AAV1 + 9 | AAV1 + 10 | AAV1 + 11 | AAV1 + 12 |
| | AAV2 | AAV2 + 8 | AAV2 + 9 | AAV2 + 10 | AAV2 + 11 | AAV2 + 12 |
| | AAV3 | AAV3 + 8 | AAV3 + 9 | AAV3 + 10 | AAV3 + 11 | AAV3 + 12 |
| | AAV4 | AAV4 + 8 | AAV4 + 9 | AAV4 + 10 | AAV4 + 11 | AAV4 + 12 |
| | AAV5 | AAV5 + 8 | AAV5 + 9 | AAV5 + 10 | AAV5 + 11 | AAV5 + 12 |
| | AAV6 | AAV6 + 8 | AAV6 + 9 | AAV6 + 10 | AAV6 + 11 | AAV6 + 12 |
| | AAV7 | AAV7 + 8 | AAV7 + 9 | AAV7 + 10 | AAV7 + 11 | AAV7 + 12 |
| | AAV8 | x | AAV8 + 9 | AAV8 + 10 | AAV8 + 11 | AAV8 + 12 |
| | AAV9 | AAV9 + 8 | x | AAV9 + 10 | AAV9 + 11 | AAV9 + 12 |
| | AAV10 | AAV10 + 8 | AAV10 + 9 | x | AAV10 + 11 | AAV10 + 12 |
| | AAV11 | AAV11 + 8 | AAV11 + 9 | AAV11 + 10 | x | AAV11 + 12 |
| | AAV12 | AAV12 + 8 | AAV12 + 9 | AAV12 + 10 | AAV12 + 11 | x |

By including individual amino acids or regions from multiple AAV serotypes in one capsid protein, capsid proteins that have multiple desired properties that are separately derived from the multiple AAV serotypes may be obtained.

crystal structure of AAV2 (Xie et al., (2002) Proc. Nat. Acad. Sci. 99: 10405-10), AAV9 (DiMattia et al., (2012) J. Virol. 86:6947-6958), AAV8 (Nam et al, (2007) J. Virol. 81: 12260-12271), AAV6 (Ng et al., (2010) J. Virol. 84:12945-

12957), AAV5 (Govindasamy et al. (2013) J. Virol. 87, 11187-11199), AAV4 (Govindasamy et al. (2006) J. Virol. 80:11556-11570), AAV3B (Lerch et al., (2010) Virology 403:26-36), BPV (Kailasan et al., (2015) J. Virol. 89:2603-2614) and CPV (Xie et al, (1996) J. Mol. Biol. 6:497-520 and Tsao et al, (1991) Science 251:1456-64).

TABLE 2

| | GenBank Accession Number | | GenBank Accession Number | | GenBank Accession Number |
|---|---|---|---|---|---|
| Complete Genomes | | Clade C | | Rh57 | AY530569 |
| Adeno-associated virus 1 | NC_002077, AF063497 | Hu9 | AY530629 | Rh50 | AY530563 |
| Adeno-associated virus 2 | NC_001401 | Hu10 | AY530576 | Rh49 | AY530562 |
| Adeno-associated virus 3 | NC_001729 | Hu11 | AY530577 | Hu39 | AY530601 |
| Adeno-associated virus 3B | NC_001863 | Hu53 | AY530615 | Rh58 | AY530570 |
| Adeno-associated virus 4 | NC_001829 | Hu55 | AY530617 | Rh61 | AY530572 |
| Adeno-associated virus 5 | Y18065, AF085716 | Hu54 | AY530616 | Rh52 | AY530565 |
| Adeno-associated virus 6 | NC_001862 | Hu7 | AY530628 | Rh53 | AY530566 |
| Avian AAV ATCC VR-865 | AY186198, AY629583, NC_004828 | Hu18 | AY530583 | Rh51 | AY530564 |
| Avian AAV strain DA-1 | NC_006263, AY629583 | Hu15 | AY530580 | Rh64 | AY530574 |
| Bovine AAV | NC_005889, AY388617, AAR26465 | Hu16 | AY530581 | Rh43 | AY530560 |
| AAV11 | AAT46339, AY631966 | Hu25 | AY530591 | AAV8 | AF513852 |
| AAV12 | ABI16639, DQ813647 | Hu60 | AY530622 | Rh8 | AY242997 |
| Clade A | | Ch5 | AY243021 | Rh1 | AY530556 |
| AAV1 | NC_002077, AF063497 | Hu3 | AY530595 | Clade F | |
| AAV6 | NC_001862 | Hu1 | AY530575 | Hu14 (AAV9) | AY530579 |
| Hu.48 | AY530611 | Hu4 | AY530602 | Hu31 | AY530596 |
| Hu 43 | AY530606 | Hu2 | AY530585 | Hu32 | AY530597 |
| Hu 44 | AY530607 | Hu61 | AY530623 | HSC1 | MI332400.1 |
| Hu 46 | AY530609 | Clade D | | HSC2 | MI332401.1 |
| Clade B | | Rh62 | AY530573 | HSC3 | MI332402.1 |
| Hu. 19 | AY530584 | Rh48 | AY530561 | HSC4 | MI332403.1 |
| Hu. 20 | AY530586 | Rh54 | AY530567 | HSC5 | MI332405.1 |
| Hu 23 | AY530589 | Rh55 | AY530568 | HSC6 | MI332404.1 |
| Hu22 | AY530588 | Cy2 | AY243020 | HSC7 | MI332407.1 |
| Hu24 | AY530590 | AAV7 | AF513851 | HSC8 | MI332408.1 |
| Hu21 | AY530587 | Rh35 | AY243000 | HSC9 | MI332409.1 |
| Hu27 | AY530592 | Rh37 | AY242998 | HSC11 | MI332406.1 |
| Hu28 | AY530593 | Rh36 | AY242999 | HSC12 | MI332410.1 |
| Hu 29 | AY530594 | Cy6 | AY243016 | HSC13 | MI332411.1 |
| Hu63 | AY530624 | Cy4 | AY243018 | HSC14 | MI332412.1 |
| Hu64 | AY530625 | Cy3 | AY243019 | HSC15 | MI332413.1 |
| Hu13 | AY530578 | Cy5 | AY243017 | HSC16 | MI332414.1 |
| Hu56 | AY530618 | Rh13 | AY243013 | HSC17 | MI332415.1 |
| Hu57 | AY530619 | Clade E | | Hu68 | |
| Hu49 | AY530612 | Rh38 | AY530558 | Clonal Isolate | |
| Hu58 | AY530620 | Hu66 | AY530626 | AAV5 | Y18065, AF085716 |
| Hu34 | AY530598 | Hu42 | AY530605 | AAV 3 | NC_001729 |
| Hu35 | AY530599 | Hu67 | AY530627 | AAV 3B | NC_001863 |
| AAV2 | NC_001401 | Hu40 | AY530603 | AAV4 | NC_001829 |
| Hu45 | AY530608 | Hu41 | AY530604 | Rh34 | AY243001 |
| Hu47 | AY530610 | Hu37 | AY530600 | Rh33 | AY243002 |
| Hu51 | AY530613 | Rh40 | AY530559 | Rh32 | AY243003 |
| Hu52 | AY530614 | Rh2 | AY243007 | Others | |
| Hu T41 | AY695378 | Bb1 | AY243023 | Rh74 | |
| Hu S17 | AY695376 | Bb2 | AY243022 | Bearded Dragon AAV | |
| Hu T88 | AY695375 | Rh10 | AY243015 | Snake AAV | NC_006148.1 |
| Hu T71 | AY695374 | Hu17 | AY530582 | | |
| Hu T70 | AY695373 | Hu6 | AY530621 | | |

TABLE 2-continued

|  | GenBank Accession Number |  | GenBank Accession Number |  | GenBank Accession Number |
|---|---|---|---|---|---|
| Hu T40 | AY695372 | Rh25 | AY530557 |  |  |
| Hu T32 | AY695371 | Pi2 | AY530554 |  |  |
| Hu T17 | AY695370 | Pi1 | AY530553 |  |  |
| Hu LG15 | AY695377 | Pi3 | AY530555 |  |  |

The term "tropism" as used herein refers to preferential entry of the virus into certain cells or tissues, optionally followed by expression (e.g., transcription and, optionally, translation) of a sequence(s) carried by the viral genome in the cell, e.g., for a recombinant virus, expression of a heterologous nucleic acid(s) of interest.

Those skilled in the art will appreciate that transcription of a heterologous nucleic acid sequence from the viral genome may not be initiated in the absence of trans-acting factors, e.g., for an inducible promoter or otherwise regulated nucleic acid sequence. In the case of a rAAV genome, gene expression from the viral genome may be from a stably integrated provirus, from a non-integrated episome, as well as any other form in which the virus may take within the cell.

As used herein, "systemic tropism" and "systemic transduction" (and equivalent terms) indicate that the virus capsid or virus vector of the disclosure exhibits tropism for or transduces, respectively, tissues throughout the body (e.g., brain, lung, skeletal muscle, heart, liver, kidney and/or pancreas). In embodiments, systemic transduction of muscle tissues (e.g., skeletal muscle, diaphragm and cardiac muscle) is observed. In other embodiments, systemic transduction of skeletal muscle tissues achieved. For example, in particular embodiments, essentially all skeletal muscles throughout the body are transduced (although the efficiency of transduction may vary by muscle type). In particular embodiments, systemic transduction of limb muscles, cardiac muscle and diaphragm muscle is achieved. Optionally, the virus capsid or virus vector is administered via a systemic route (e.g., systemic route such as intravenously, intra-articularly or intra-lymphatically).

Alternatively, in other embodiments, the capsid or virus vector is delivered locally (e.g., to the footpad, intramuscularly, intradermally, subcutaneously, topically). Unless indicated otherwise, "efficient transduction" or "efficient tropism," or similar terms, can be determined by reference to a suitable control (e.g., at least about 50%, about 60%, about 70%, about 80%, about 85%, about 90%, about 95% or more of the transduction or tropism, respectively, of the control). In particular embodiments, the virus vector efficiently transduces or has efficient tropism for skeletal muscle, cardiac muscle, diaphragm muscle, pancreas (including β-islet cells), spleen, the gastrointestinal tract (e.g., epithelium and/or smooth muscle), cells of the central nervous system, eye, lung, joint cells, and/or kidney. Suitable controls will depend on a variety of factors including the desired tropism profile. For example, AAV8 and AAV9 are highly efficient in transducing skeletal muscle, cardiac muscle and diaphragm muscle, but have the disadvantage of also transducing liver with high efficiency. Thus, viral vectors can be identified that demonstrate the efficient transduction of skeletal, cardiac and/or diaphragm muscle of AAV8 or AAV9, but with a much lower transduction efficiency for liver. Further, because the tropism profile of interest may reflect tropism toward multiple target tissues, it will be appreciated that a suitable vector may represent some tradeoffs. To illustrate, a virus vector of the disclosure may be less efficient than AAV8 or AAV9 in transducing skeletal muscle, cardiac muscle and/or diaphragm muscle, but because of low level transduction of liver, may nonetheless be very desirable.

Similarly, it can be determined if a virus "does not efficiently transduce" or "does not have efficient tropism" for a target tissue, or similar terms, by reference to a suitable control. In particular embodiments, the virus vector does not efficiently transduce (i.e., has does not have efficient tropism) for liver, kidney, gonads and/or germ cells. In particular embodiments, undesirable transduction of tissue(s) (e.g., liver) is about 20% or less, about 10% or less, about 5% or less, about 1% or less, about 0.1% or less of the level of transduction of the desired target tissue(s) (e.g., skeletal muscle, diaphragm muscle, cardiac muscle and/or cells of the central nervous system).

As used herein, the term "polypeptide" encompasses both peptides and proteins, unless indicated otherwise.

A "polynucleotide" is a sequence of nucleotide bases, and may be RNA, DNA or DNA-RNA hybrid sequences (including both naturally occurring and non-naturally occurring nucleotide), but in representative embodiments are either single or double stranded DNA sequences.

As used herein, an "isolated" polynucleotide (e.g., an "isolated DNA" or an "isolated RNA") means a polynucleotide at least partially separated from at least some of the other components of the naturally occurring organism or virus, for example, the cell or viral structural components or other polypeptides or nucleic acids commonly found associated with the polynucleotide. In representative embodiments an "isolated" nucleotide is enriched by at least about 10-fold, about 100-fold, about 1000-fold, about 10,000-fold or more as compared with the starting material.

Likewise, an "isolated" polypeptide means a polypeptide that is at least partially separated from at least some of the other components of the naturally occurring organism or virus, for example, the cell or viral structural components or other polypeptides or nucleic acids commonly found associated with the polypeptide. In representative embodiments an "isolated" polypeptide is enriched by at least about 10-fold, 100-fold, 1000-fold, 10,000-fold or more as compared with the starting material.

As used herein, by "isolate" or "purify" (or grammatical equivalents) a virus vector, it is meant that the virus vector is at least partially separated from at least some of the other components in the starting material. In representative embodiments an "isolated" or "purified" virus vector is enriched by at least about 10-fold, about 100-fold, about 1000-fold, about 10,000-fold or more as compared with the starting material.

A "therapeutic polypeptide" is a polypeptide that can alleviate, reduce, prevent, delay and/or stabilize symptoms that result from an absence or defect in a protein in a cell or subject and/or is a polypeptide that otherwise confers a benefit to a subject, e.g., anti-cancer effects or improvement in transplant survivability.

By the terms "treat," "treating" or "treatment of" (and grammatical variations thereof) it is meant that the severity of the subject's condition is reduced, at least partially improved or stabilized and/or that some alleviation, mitigation, decrease or stabilization in at least one clinical symptom is achieved and/or there is a delay in the progression of the disease or disorder.

The terms "prevent," "preventing" and "prevention" (and grammatical variations thereof) refer to prevention and/or delay of the onset of a disease, disorder and/or a clinical symptom(s) in a subject and/or a reduction in the severity of the onset of the disease, disorder and/or clinical symptom(s) relative to what would occur in the absence of the methods of the disclosure. The prevention can be complete, e.g., the total absence of the disease, disorder and/or clinical symptom(s). The prevention can also be partial, such that the occurrence of the disease, disorder and/or clinical symptom(s) in the subject and/or the severity of onset is less than what would occur in the absence of the present disclosure.

"Therapeutically effective amount" as used herein refers to an amount that, when administered to a subject for treating a disease, or at least one of the clinical symptoms of a disease, is sufficient to affect such treatment of the disease or symptom thereof. The "therapeutically effective amount" may vary depending, for example, on the disease and/or symptoms of the disease, severity of the disease and/or symptoms of the disease or disorder, the age, weight, and/or health of the patient to be treated, and the judgment of the prescribing physician. An appropriate amount in any given instance may be ascertained by those skilled in the art or capable of determination by routine experimentation.

As used herein, the terms "virus vector," "vector" or "gene delivery vector" refer to a virus (e.g., AAV) particle that functions as a nucleic acid delivery vehicle, and which comprises the vector genome (e.g., viral DNA [vDNA]) packaged within a virion.

Alternatively, in some contexts, the term "vector" may be used to refer to the vector genome/vDNA alone.

A "rAAV vector genome" or "rAAV genome" is an AAV genome (i.e., vDNA) that comprises one or more heterologous nucleic acid sequences. rAAV vectors generally require only the terminal repeat(s) (TR(s)) in cis to generate virus. All other viral sequences are dispensable and may be supplied in trans (Muzyczka, (1992) Curr. Topics Microbiol. Immunol. 158:97). Typically, the rAAV vector genome will only retain the one or more TR sequence so as to maximize the size of the transgene that can be efficiently packaged by the vector. The structural and non-structural protein coding sequences may be provided in trans (e.g., from a vector, such as a plasmid, or by stably integrating the sequences into a packaging cell). In embodiments, the rAAV vector genome comprises at least one TR sequence (e.g., AAV TR sequence), optionally two TRs (e.g., two AAV TRs), which typically will be at the 5' and 3' ends of the vector genome and flank the heterologous nucleic acid, but need not be contiguous thereto. The TRs can be the same or different from each other.

The term "terminal repeat" or "TR" includes any viral terminal repeat or synthetic sequence that forms a hairpin structure and functions as an inverted terminal repeat (i.e., mediates the desired functions such as replication, virus packaging, integration and/or provirus rescue, and the like). The TR can be an AAV TR or a non-AAV TR. For example, a non-AAV TR sequence such as those of other parvoviruses (e.g., canine parvovirus (CPV), mouse parvovirus (MVM), human parvovirus B-19) or any other suitable virus sequence (e.g., the SV40 hairpin that serves as the origin of SV40 replication) can be used as a TR, which can further be modified by truncation, substitution, deletion, insertion and/or addition. Further, the TR can be partially or completely synthetic, such as the "double-D sequence" as described in U.S. Pat. No. 5,478,745 to Samulski et al.

An "AAV terminal repeat" or "AAV TR" may be from any AAV, including but not limited to serotypes 1, 2, 3, 4, 5, 6, 7, 8, 9, 10, 11, 12, 13 or any other AAV now known or later discovered (see, e.g., Table 2). An AAV terminal repeat need not have the native terminal repeat sequence (e.g., a native AAV TR sequence may be altered by insertion, deletion, truncation and/or missense mutations), as long as the terminal repeat mediates the desired functions, e.g., replication, virus packaging, integration, and/or provirus rescue, and the like.

The virus vectors of the disclosure can further be "targeted" virus vectors (e.g., having a directed tropism) and/or a "hybrid" parvovirus (i.e., in which the viral TRs and viral capsid are from different parvoviruses) as described in international patent publication WO00/28004 and Chao et al, (2000) Molecular Therapy 2:619.

The virus vectors of the disclosure can further be duplexed parvovirus particles as described in international patent publication WO 01/92551 (the disclosure of which is incorporated herein by reference in its entirety). Thus, in some embodiments, double stranded (duplex) genomes can be packaged into the virus capsids of the disclosure.

Further, the viral capsid or genomic elements can contain other modifications, including insertions, deletions and/or substitutions.

As used herein, the term "amino acid" encompasses any naturally occurring amino acid, modified forms thereof, and synthetic amino acids.

Naturally occurring, levorotatory (L-) amino acids are shown in Table 3.

TABLE 3

Amino acid residues and abbreviations.

| Amino Acid Residue | Abbreviation | |
|---|---|---|
| | Three-Letter Code | One-Letter Code |
| Alanine | Ala | A |
| Arginine | Arg | R |
| Asparagine | Asn | N |
| Aspartic acid (Aspartate) | Asp | D |
| Cysteine | Cys | C |
| Glutamine | Gln | Q |
| Glutamic acid (Glutamate) | Glu | E |
| Glycine | Gly | G |
| Histidine | His | H |
| Isoleucine | Ile | I |
| Leucine | Leu | L |
| Lysine | Lys | K |
| Methionine | Met | M |
| Phenylalanine | Phe | F |
| Proline | Pro | P |
| Serine | Ser | S |
| Threonine | Thr | T |
| Tryptophan | Trp | W |
| Tyrosine | Tyr | Y |
| Valine | Val | V |

Alternatively, the amino acid can be a modified amino acid residue (nonlimiting examples are shown in Table 4) and/or can be an amino acid that is modified by post-translation modification (e.g., acetylation, amidation, formylation, hydroxylation, methylation, phosphorylation or sulfatation).

TABLE 4

Modified Amino Acid Residues

| Modified Amino Acid Residue Amino Acid Residue Derivatives | Abbreviation |
|---|---|
| 2-Aminoadipic acid | Aad |
| 3-Aminoadipic acid | bAad |
| beta-Alanine, beta-Aminoproprionic acid | bAla |
| 2-Aminobutyric acid | Abu |
| 4-Aminobutyric acid, Piperidinic acid | 4Abu |
| 6-Aminocaproic acid | Acp |
| 2-Aminoheptanoic acid | Ahe |
| 2-Aminoisobutyric acid | Aib |
| 3-Aminoisobutyric acid | bAib |
| 2-Aminopimelic acid | Apm |
| t-butylalanine | t-BuA |
| Citrulline | Cit |
| Cyclohexylalanine | Cha |
| 2,4-Diaminobutyric acid | Dbu |
| Desmosine | Des |
| 2,21-Diaminopimelic acid | Dpm |
| 2,3-Diaminoproprionic acid | Dpr |
| N-Ethylglycine | EtGly |
| N-Ethylasparagine | EtAsn |
| Homoarginine | hArg |
| Homocysteine | hCys |
| Homoserine | hSer |
| Hydroxylysine | Hyl |
| Allo-Hydroxylysine | aHyl |
| 3-Hydroxyproline | 3Hyp |
| 4-Hydroxyproline | 4Hyp |
| Isodesmosine | Ide |
| allo-Isoleucine | alle |
| Methionine sulfoxide | MSO |
| N-Methylglycine, sarcosine | MeGly |
| N-Methyl isoleucine | MeIle |
| 6-N-Methyllysine | MeLys |
| N-Methylvaline | MeVal |
| 2-Naphthylalanine | 2-Nal |
| Norvaline | Nva |
| Norleucine | Nle |
| Ornithine | Orn |
| 4-Chlorophenylalanine | Phe(4-Cl) |
| 2-Fluorophenylalanine | Phe(2-F) |
| 3-Fluorophenylalanine | Phe(3-F) |
| 4-Fluorophenylalanine | Phe(4-F) |
| Phenylglycine | Phg |
| Beta-2-thienylalanine | Thi |

Further, the non-naturally occurring amino acid can be an "unnatural" amino acid (as described by Wang et al., Annu Rev Biophys Biomol Struct. 35:225-49 (2006)). These unnatural amino acids can advantageously be used to chemically link molecules of interest to the AAV capsid protein. Modified AAV Capsid Proteins and Virus Capsids and Virus Vectors Comprising the Same.

The present disclosure provides AAV capsid proteins (VP1, VP2 and/or VP3) comprising a modification (e.g., a substitution and/or a deletion) in the amino acid sequence and virus capsids and virus vectors comprising the modified AAV capsid protein. The inventors have discovered that the modifications described herein can confer one or more desirable properties to virus vectors comprising the modified AAV capsid protein including without limitation, selective transduction to a target tissue of interest. In some embodiments, the target tissue of interest may be an ophthalmic tissue, such as the retinal pigment epithelium (RPE). Thus, the present disclosure addresses some of the limitations associated with conventional AAV vectors.

As used herein, a "mutation" or "modification" in an amino acid sequence can include substitutions, insertions and/or deletions, each of which can involve one, two, three, four, five, six, seven, eight, nine, ten or more amino acids. In particular embodiments, the modification is a substitution.

The modified virus capsid proteins of the invention can be but are not limited to AAV capsid proteins in which amino acids from one AAV capsid protein are substituted into another AAV capsid protein, and the substituted and/or inserted amino acids can be from any source, and can further be natural or partially or completely synthetic.

In some embodiments, the present disclosure provides an adeno-associated virus (AAV) capsid protein, comprising one or more amino acid substitutions, wherein the one or more substitutions modify one or more surface-exposed loops on the AAV capsid protein. The modification of the one or more surface-exposed loops results in enhanced transduction to a target tissue. The target tissue may be an ophthalmic tissue, such as the retinal pigment epithelium (RPE). The one or more amino acid substitutions can be in one or more surface-exposed loops identified by peptide epitope mapping and/or cryo-electron microscopy studies.

The capsid proteins of this disclosure are modified to produce an AAV capsid that is present in an AAV virus particle or AAV virus vector that has a phenotype of enhanced transduction with respect to a target tissue of interest (e.g., an ophthalmic tissue such as the retinal pigment epithelium). The AAV virus particle or vector of this disclosure can also have a phenotype of evading neutralizing antibodies.

In some embodiments, the one or more substitutions of the one or more surface-exposed loops can introduce one or more surface-exposed loops from a capsid protein of a first AAV serotype into the capsid protein of a second AAV serotype that is different from said first AAV serotype.

The AAV capsid protein of this disclosure can be a capsid protein of an AAV serotype selected from AAV1, AAV2, AAV3, AAV3B, AAV4, AAV5, AAV6, AAV7, AAV8, AAV9, AAV10, AAV11, AAV12, AAVrh.8, AAVrh.10, AAVrh.32.33, AAVrh74, bovine AAV, avian AAV or any other AAV now known or later identified. In some embodiments, the AAV capsid protein is chimeric.

In some embodiments, the amino acid substitution replaces any six amino acids in an AAV capsid protein from any one of the serotypes listed in the preceding paragraph. For example, the amino acid substitution may replace the following amino acids (VP1 numbering) in an AAV capsid protein from any one of the serotypes listed in the preceding paragraph: 397-402, 403-408, 409-414, 415-420, 421-426, 427-432, 433-438, 439-444, 445-450, 451-456, 457-462, 463-468, 469-474, 475-480, 481-486, 487-492, 493-489, 490-495, 496-501, 500-505, 506-510, 511-517, 523-528, 529-534, 535-540, 541-546, 547-552, 553-558, 559-560, 561-565, 566-571, 572-577, 578-583, 584-589, 590-595, 596-601, 602-607, 608-613, 614-619, 620-625, 626-631, 632-637, 638-642, 643-648, 649-654, 655-670, 617-676, 677-682, 683-688, 689-694, 695-700, 701-706.

In some embodiments, the AAV capsid protein comprises one or more amino acid substitutions that do not occur in the capsid sequence, wherein the amino acid substitutions are selected from the sequences listed in Table 5.

TABLE 5

AMINO ACID SUBSTITUTIONS

| Sequence Substitution | SEQ ID NO. |
|---|---|
| KVRDLF | 14 |
| RVLALR | 15 |
| RVHALR | 16 |

TABLE 5-continued

AMINO ACID SUBSTITUTIONS

| Sequence Substitution | SEQ ID NO. |
|---|---|
| RVHSLR | 17 |
| GVGVLP | 18 |
| FVNALN | 19 |
| IVRSLN | 20 |
| HVLRLN | 21 |
| RVLALQ | 22 |
| RVRGLR | 187 |
| KVRTLR | 188 |
| MVGNLV | 189 |
| RVLGLR | 190 |
| KVAGLC | 191 |
| IVRPLV | 192 |
| KVRGLA | 193 |
| RVRGLG | 194 |

In some embodiments, the amino acid substitution replaces the amino acids in the region corresponding to amino acid positions 591-596 of SEQ ID NO. 11 or amino acids 590-595 of SEQ ID NO. 12.

In some embodiments, the AAV capsid comprises the amino acid sequence of any one of SEQ ID NO: 11-12, 23-49, or 195-254. In some embodiments, the capsid comprises an amino acid sequence that has at least 90%, at least 95%, at least 96%, at least 97%, at least 98% or at least 99% sequence homology with any one of SEQ ID NO: 11-12, 23-49, or 195-254.

In some embodiments, a recombinant capsid protein has a sequence that is at least 90%, at least 95%, at least 96%, at least 97%, at least 98%, at least 99% or 100% identical to any one of SEQ ID NO: 32, 35, 37, or 40.

In some embodiments, an AAV capsid protein of SEQ ID NO: 4 comprises one or more of the following amino acid substitutions: K492E, K503E, N585S, T590K, T590R, T590G, T590F, T590I, T590H, T590M, D592R, D592L, D592H, D592G, D592N, D592A, R593D, R593A, R593S, R593V, R593R, R593G, R593T, R593N, R593P, T595F, T595R, T595P, T595N, T595Q, T595V, T595C, T595A, T595G.

In some embodiments, an AAV capsid protein of SEQ ID NO: 11 comprises one or more of the following amino acid substitutions: T591K, T591R, T591G, T591F, T591 I, T591H, T591M, D593R, D593L, D593H, D593G, D593N, D593A, R594D, R594A, R594S, R594V, R594R, R594G, R594T, R594N, R594P, T596F, T596R, T596P, T596N, T596Q, T596V, T596C, T596A, T596G.

In some embodiments, an AAV capsid protein of SEQ ID NO: 12 comprises one or more of the following amino acid substitutions: T590K, T590R, T590G, T590F, T590I, T590H, T590M, D592R, D592L, D592H, D592G, D592N, D592A, R593D, R593A, R593S, R593V, R593R, R593G, R593T, R593N, R593P, T595F, T595R, T595P, T595N, T595Q, T595V, T595C, T595A, T595G.

In some embodiments, the AAV capsid protein comprises a substitution comprising a sequence of six amino acids ($X^1$-$X^2$-$X^3$-$X^4$-$X^5$-$X^6$) that does not occur in the native AAV capsid protein, wherein $X^2$ is V and $X^5$ is L (SEQ ID NO: 186). In some embodiments, $X^1$ is not T, $X^3$ is not D, $X^4$ is not R, and $X^6$ is not T (SEQ ID NO: 255). In some embodiments, $X^1$ is K, G, F, I, H, or R (SEQ ID NO: 256). In some embodiments, $X^3$ is R, L, H, G, or N (SEQ ID NO: 257). In some embodiments, $X^4$ is D, A, S, V, or R (SEQ ID NO: 258). In some embodiments, $X^6$ is F, R, P, N, or Q (SEQ ID NO: 259). In some embodiments, $X^1$ is K, $X^3$ is R, $X^4$ is D, and $X^6$ is F (SEQ ID NO: 14). In some embodiments, $X^1$ is R, $X^3$ is L, $X^4$ is A, and $X^6$ is R (SEQ ID NO: 15). In some embodiments, $X^1$ is R, $X^3$ is H, $X^4$ is A, and $X^6$ is R (SEQ ID NO: 16). In some embodiments, $X^1$ is R, $X^3$ is H, $X^4$ is S, and $X^6$ is R (SEQ ID NO: 17). In some embodiments, $X^1$ is G, $X^3$ is G, $X^4$ is V, and $X^6$ is P (SEQ ID NO: 18). In some embodiments, $X^1$ is F, $X^3$ is N, $X^4$ is A, and $X^6$ is N (SEQ ID NO: 19). In some embodiments, $X^1$ is I, $X^3$ is R, $X^4$ is S, and $X^6$ is N (SEQ ID NO: 20). In some embodiments, $X^1$ is H, $X^3$ is L, $X^4$ is R, and $X^6$ is N (SEQ ID NO: 21). In some embodiments, $X^1$ is R, $X^3$ is L, $X^4$ is A, and $X^6$ is Q (SEQ ID NO: 22). In some embodiments, $X^1$ is R, $X^3$ is L, $X^4$ is A, and $X^6$ is Q (SEQ ID NO: 187). In some embodiments, $X^1$ is K, $X^3$ is R, $X^4$ is T, and $X^6$ is R (SEQ ID NO: 188). In some embodiments, $X^1$ is M, $X^3$ is G, $X^4$ is N, and $X^6$ is V (SEQ ID NO: 189). In some embodiments, $X^1$ is R, $X^3$ is L, $X^4$ is G, and $X^6$ is R (SEQ ID NO: 190). In some embodiments, $X^1$ is K, $X^3$ is A, $X^4$ is G, and $X^6$ is C (SEQ ID NO: 191). In some embodiments, $X^1$ is I, $X^3$ is V, $X^4$ is R, and $X^6$ is V (SEQ ID NO: 192). In some embodiments, $X^1$ is K, $X^3$ is R, $X^4$ is G, and $X^6$ is A (SEQ ID NO: 193). In some embodiments, $X^1$ is R, $X^3$ is R, $X^4$ is G, and $X^6$ is G (SEQ ID NO: 194).

The present disclosure also provides a nucleotide sequence, or an expression vector comprising the same, that encodes one or more of the AAV capsid proteins of the disclosure. The nucleotide sequence may be a DNA sequence or an RNA sequence. The present disclosure also provides a cell that comprises one or more nucleotide sequences or expression vectors of the disclosure.

Also provided is an AAV capsid comprising an AAV capsid protein of this disclosure. Further provided herein is a viral vector comprising an AAV capsid of this disclosure as well as a composition comprising the AAV capsid protein, AAV capsid and/or viral vector of this disclosure in a pharmaceutically acceptable carrier.

In some embodiments, modification of the one or more surface-exposed loops results in an enhanced transduction profile with respect to a target tissue of interest, for example an ophthalmic tissue such as the retinal pigment epithelium (RPE). In some embodiments, modification of the one or more surface-exposed loops results in inhibition of binding by an antibody to one or more antigenic sites on the AAV capsid protein. In some embodiments, modification of the one or more surface-exposed loops results in inhibition of neutralization of infectivity of a virus particle comprising the AAV capsid protein.

As described herein, the nucleic acid and amino acid sequences of the capsid proteins from a number of AAV are known in the art. Thus, the amino acids "corresponding" to amino acid positions of the native AAV capsid protein can be readily determined for any other AAV (e.g., by using sequence alignments).

The disclosure contemplates that the modified capsid proteins can be produced by modifying the capsid protein of any AAV now known or later discovered.

Further, the AAV capsid protein that is to be modified can be a naturally occurring AAV capsid protein (e.g., an AAV2, AAV3a or 3b, AAV4, AAV5, AAV6, AAV7, AAV8, AAV9, AAV10 or AAV11 capsid protein or any of the AAV shown in Table 2) but is not so limited. Those skilled in the art will understand that a variety of manipulations to the AAV capsid proteins are known in the art and the disclosure is not limited to modifications of naturally occurring AAV capsid proteins. For example, the capsid protein to be modified may already have alterations as compared with naturally occurring AAV (e.g., is derived from a naturally occurring AAV capsid protein, e.g., AAV2, AAV3a, AAV3b, AAV4, AAV5, AAV6, AAV7, AAV8, AAV9, AAV10, AAV11, AAV12 or any other AAV now known or later discovered). In some embodiments, the capsid protein to be modified may be a chimeric capsid protein. In some embodiments, the capsid protein to be modified may be an engineered AAV, such as AAV2i8, AAV2g9, AAV-LK03, AAV7m8, AAV Anc80, AAV PHP.B. In some embodiments, the capsid protein to be modified may have the sequence of SEQ ID NO:11 or SEQ ID NO:12.

Thus, in particular embodiments, the AAV capsid protein to be modified can be derived from a naturally occurring AAV but further comprises one or more foreign sequences (e.g., that are exogenous to the native virus) that are inserted and/or substituted into the capsid protein and/or has been altered by deletion of one or more amino acids.

Accordingly, when referring herein to a specific AAV capsid protein (e.g., an AAV2, AAV3, AAV4, AAV5, AAV6, AAV7, AAV8, AAV9, AAV10 or AAV11 capsid protein or a capsid protein from any of the AAV shown in Table 2, etc.), it is intended to encompass the native capsid protein as well as capsid proteins that have alterations other than the modifications of the disclosure. Such alterations include substitutions, insertions and/or deletions. In particular embodiments, the capsid protein comprises 1, 2, 3, 4, 5, 6, 7, 8, 9, 10, 11, 12, 13, 14, 15, 16, 17, 18, 19 or 20, less than 20, less than 30, less than 40, less than 50, less than 60, or less than 70 amino acids inserted therein (other than the insertions of the present disclosure) as compared with the native AAV capsid protein sequence. In embodiments, the capsid protein comprises 1, 2, 3, 4, 5, 6, 7, 8, 9, 10, 11, 12, 13, 14, 15, 16, 17, 18, 19 or 20, less than 20, less than 30, less than 40, less than 50, less than 60, or less than 70 amino acid substitutions (other than the amino acid substitutions according to the present disclosure) as compared with the native AAV capsid protein sequence, in embodiments of the disclosure, the capsid protein comprises a deletion of 1, 2, 3, 4, 5, 6, 7, 8, 9, 10, 11, 12, 13, 14, 15, 16, 17, 18, 19 or 20, less than 20, less than 30, less than 40, less than 50, less than 60, or less than 70 amino acids (other than the amino acid deletions of the disclosure) as compared with the native AAV capsid protein sequence.

In particular embodiments, the AAV capsid protein has the native AAV capsid protein sequence or has an amino acid sequence that is at least about 90%, about 95%, about 97%, about 98% or about 99% similar or identical to a native AAV capsid protein sequence. For example, in particular embodiments, an "AAV4" capsid protein encompasses the native AAV4 capsid protein sequence as well as sequences that are at least about 90%, about 95%, about 97%, about 98% or about 99% similar or identical to the native AAV4 capsid protein sequence.

Methods of determining sequence similarity or identity between two or more amino acid sequences are known in the art. Sequence similarity or identity may be determined using standard techniques known in the art, including, but not limited to, the local sequence identity algorithm of Smith & Waterman, Adv. Appl. Math. 2, 482 (1981), by the sequence identity alignment algorithm of Needleman & Wunsch, J Mol. Biol. 48,443 (1970), by the search for similarity method of Pearson & Lipman, Proc. Natl. Acad. Sci. USA 85,2444 (1988), by computerized implementations of these algorithms (GAP, BESTFIT, FASTA, and TFASTA in the Wisconsin Genetics Software Package, Genetics Computer Group, 575 Science Drive, Madison, WI), the Best Fit sequence program described by Devereux et al., Nucl. Acid Res. 12, 387-395 (1984), or by inspection.

Another suitable algorithm is the BLAST algorithm, described in Altschul et al., J Mol. Biol. 215, 403-410, (1990) and Karlin et al., Proc. Natl. Acad. Sci. USA 90, 5873-5787 (1993). A particularly useful BLAST program is the WU-BLAST-2 program which was obtained from Altschul et al., Methods in Enzymology, 266, 460-480 (1996); http://blast.wustl/edu/blast/README.html.

WU-BLAST-2 uses several search parameters, which are optionally set to the default values. The parameters are dynamic values and are established by the program itself depending upon the composition of the particular sequence and composition of the particular database against which the sequence of interest is being searched; however, the values may be adjusted to increase sensitivity. Further, an additional useful algorithm is gapped BLAST as reported by Altschul et al, (1997) Nucleic Acids Res. 25, 3389-3402.

The disclosure also provides a virus capsid comprising, consisting essentially of, or consisting of the modified AAV capsid protein of the disclosure. In particular embodiments, the virus capsid is a parvovirus capsid, which may further be an autonomous parvovirus capsid or a dependovirus capsid. Optionally, the virus capsid is an AAV capsid. In particular embodiments, the AAV capsid is an AAV1, AAV2, AAV3a, AAV3b, AAV4, AAV5, AAV6, AAV7, AAV8, AAV9, AAV10, AAV11, AAV12, AAVrh8, AAVrh10, AAVrh32.33, bovine AAV capsid, avian AAV capsid or any other AAV now known or later identified. A nonlimiting list of AAV serotypes is shown in Table 2. An AAV capsid of this disclosure can be any AAV serotype listed in Table 2 or derived from any of the foregoing by one or more insertions, substitutions and/or deletions.

The modified virus capsids can be used as "capsid vehicles," as has been described, for example, in U.S. Pat. No. 5,863,541. Molecules that can be packaged by the modified virus capsid and transferred into a cell include heterologous DNA, RNA, polypeptides, small organic molecules, metals, or combinations of the same.

Heterologous molecules are defined as those that are not naturally found in an AAV infection, e.g., those not encoded by a wild-type AAV genome. Further, therapeutically useful molecules can be associated with the outside of the chimeric virus capsid for transfer of the molecules into host target cells. Such associated molecules can include DNA, RNA, small organic molecules, metals, carbohydrates, lipids and/or polypeptides. In one embodiment of the disclosure the therapeutically useful molecule is covalently linked (i.e., conjugated or chemically coupled) to the capsid proteins. Methods of covalently linking molecules are known by those skilled in the art.

The modified virus capsids of the disclosure also find use in raising antibodies against the novel capsid structures. As a further alternative, an exogenous amino acid sequence may be inserted into the modified virus capsid for antigen presentation to a cell, e.g., for administration to a subject to produce an immune response to the exogenous amino acid sequence.

In other embodiments, the virus capsids can be administered to block certain cellular sites prior to and/or concurrently with (e.g., within minutes or hours of each other) administration of a virus vector delivering a nucleic acid encoding a polypeptide or functional RNA of interest. For example, the capsids of the disclosure can be delivered to block cellular receptors on liver cells and a delivery vector can be administered subsequently or concurrently, which may reduce transduction of liver cells, and enhance transduction of other targets (e.g., skeletal, cardiac and/or diaphragm muscle).

According to representative embodiments, modified virus capsids can be administered to a subject prior to and/or concurrently with a modified virus vector according to the present disclosure. Further, the disclosure provides compositions and pharmaceutical formulations comprising the modified virus capsids; optionally, the composition also comprises a modified virus vector of the disclosure.

The disclosure also provides nucleic acids (optionally, isolated nucleic acids) encoding the modified virus capsids and capsid proteins of the disclosure. Further provided are vectors comprising the nucleic acids, and cells (in vivo or in culture) comprising the nucleic acids and/or vectors of the disclosure. As one example, the present disclosure provides a virus vector comprising: (a) a modified AAV capsid of this disclosure; and (b) a nucleic acid comprising at least one terminal repeat sequence, wherein the nucleic acid is encapsidated by the AAV capsid.

Other suitable vectors include without limitation viral vectors (e.g., adenovirus, AAV, herpesvirus, vaccinia, poxviruses, baculoviruses, and the like), plasmids, phage, YACs, BACs, and the like. Such nucleic acids, vectors and cells can be used, for example, as reagents (e.g., helper packaging constructs or packaging cells) for the production of modified virus capsids or virus vectors as described herein.

Virus capsids according to the disclosure can be produced using any method known in the art, e.g., by expression from a baculovirus (Brown et al., (1994) Virology 198:477-488).

The modifications to the AAV capsid protein according to the present disclosure are "selective" modifications. This approach is in contrast to previous work with whole subunit or large domain swaps between AAV serotypes (see, e.g., international patent publication WO 00/28004 and Hauck et al., (2003) J. Virology 77:2768-2774). In particular embodiments, a "selective" modification results in the insertion and/or substitution and/or deletion of less than or equal to about 20, about 18, about 15, about 12, about 10, about 9, about 8, about 7, about 6, about 5, about 4 or about 3 contiguous amino acids.

The modified capsid proteins and capsids of the disclosure can further comprise any other modification, now known or later identified.

For example, the AAV capsid proteins and virus capsids of the disclosure can be chimeric in that they can comprise all or a portion of a capsid subunit from another virus, optionally another parvovirus or AAV, e.g., as described in international patent publication WO 00/28004.

In some embodiments of this disclosure, the virus capsid can be a targeted virus capsid, comprising a targeting sequence (e.g., substituted or inserted in the viral capsid) that directs the virus capsid to interact with cell-surface molecules present on desired target tissue(s) (see, e.g., International patent publication WO 00/28004 and Hauck et al., (2003) J. Virology 77:2768-2774); Shi et al., Human Gene Therapy 17:353-361 (2006) [describing insertion of the integrin receptor binding motif RGD at positions 520 and/or 584 of the AAV capsid subunit]; and U.S. Pat. No. 7,314,912 [describing insertion of the PI peptide containing an RGD motif following amino acid positions 447, 534, 573 and 587 of the AAV2 capsid subunit]). Other positions within the AAV capsid subunit that tolerate insertions are known in the art (e.g., positions 449 and 588 described by Grifman et al., Molecular Therapy 3:964-975 (2001)).

For example, a virus capsid of this disclosure may have relatively inefficient tropism toward certain target tissues of interest (e.g., liver, skeletal muscle, heart, diaphragm muscle, kidney, brain, stomach, intestines, skin, endothelial cells, and/or lungs). A targeting sequence can advantageously be incorporated into these low-transduction vectors to thereby confer to the virus capsid a desired tropism and, optionally, selective tropism for particular tissue(s). AAV capsid proteins, capsids and vectors comprising targeting sequences are described, for example in international patent publication WO 00/28004. As another example, one or more non-naturally occurring amino acids as described by Wang et al., Annu Rev Biophys Biomol Struct. 35:225-49 (2006)) can be incorporated into an AAV capsid subunit of this disclosure at an orthogonal site as a means of redirecting a low-transduction vector to desired target tissue(s). These unnatural amino acids can advantageously be used to chemically link molecules of interest to the AAV capsid protein including without limitation: glycans (mannose-dendritic cell targeting); RGD, bombesin or a neuropeptide for targeted delivery to specific cancer cell types; RNA aptamers or peptides selected from phage display targeted to specific cell surface receptors such as growth factor receptors, integrins, and the like.

Methods of chemically modifying amino acids are known in the art (see, e.g., Greg T. Hermanson, Bioconjugate Techniques, 1st edition, Academic Press, 1996).

In some embodiments, the targeting sequence may be a virus capsid sequence (e.g., an autonomous parvovirus capsid sequence, AAV capsid sequence, or any other viral capsid sequence) that directs infection to a particular cell type(s).

As another nonlimiting example, a heparin or heparan sulfate binding domain (e.g., the respiratory syncytial virus heparin binding domain) may be inserted or substituted into a capsid subunit that does not typically bind HS receptors (e.g., AAV4, AAV5) to confer heparin and/or heparan sulfate binding to the resulting mutant.

B19 infects primary erythroid progenitor cells using globoside as its receptor (Brown et al, (1993) Science 262:114). The structure of B19 has been determined to 8 Å resolution (Agbandje-McKenna et al, (1994) Virology 203: 106). The region of the B19 capsid that binds to globoside has been mapped between amino acids 399-406 (Chapman et al, (1993) Virology 194:419), a looped out region between β-barrel structures E and F (Chipman et al, (1996) Proc. Nat. Acad. Sci. USA 93:7502). Accordingly, the globoside receptor binding domain of the B19 capsid may be substituted into an AAV capsid protein of this disclosure to target a virus capsid or virus vector comprising the same to erythroid cells.

In some embodiments, the exogenous targeting sequence may be any amino acid sequence encoding a peptide that alters the tropism of a virus capsid or virus vector comprising the modified AAV capsid protein. In particular embodiments, the targeting peptide or protein may be naturally occurring or, alternately, completely or partially synthetic. Exemplary targeting sequences include ligands and other peptides that bind to cell surface receptors and glycoproteins, such as ROD peptide sequences, bradykinin, hormones, peptide growth factors (e.g., epidermal growth factor, nerve growth factor, fibroblast growth factor, platelet-derived growth factor, insulin-like growth factors I and II, etc.), cytokines, melanocyte stimulating hormone (e.g., α, β or γ), neuropeptides and endorphins, and the like, and fragments thereof that retain the ability to target cells to their cognate receptors. Other illustrative peptides and proteins include substance P, keratinocyte growth factor, neuropeptide Y, gastrin releasing peptide, interleukin 2, hen egg white lysozyme, erythropoietin, gonadoliberin, corticostatin, 8-endorphin, leu-enkephalin, rimorphin, alpha-neo-enkephalin, angiotensin, pneumadin, vasoactive intestinal peptide, neurotensin, motilin, and fragments thereof as described above. As yet a further alternative, the binding domain from a toxin (e.g., tetanus toxin or snake toxins, such as alpha-bungarotoxin, and the like) can be substituted into the capsid protein as a targeting sequence. In a yet further representative embodiment, the AAV capsid protein can be modified by substitution of a "nonclassical" import/export signal peptide (e.g., fibroblast growth factor-1 and -2, interleukin 1, HIV-1 Tat protein, herpes virus VP22 protein, and the like) as described by Cleves (Current Biology 7:R318 (1997)) into the AAV capsid protein. Also encompassed are peptide motifs that direct uptake by specific cells, e.g., a FVFLP (SEQ ID NO: 50) peptide motif triggers uptake by liver cells.

Phage display techniques, as well as other techniques known in the art, may be used to identify peptides that recognize any cell type of interest.

The targeting sequence may encode any peptide that targets to a cell surface binding site, including receptors (e.g., protein, carbohydrate, glycoprotein or proteoglycan). Examples of cell surface binding sites include, but are not limited to, heparan sulfate, chondroitin sulfate, and other glycosaminoglycans, sialic acid moieties found on mucins, glycoproteins, and gangliosides, MHC 1 glycoproteins, carbohydrate components found on membrane glycoproteins, including, mannose, N-acetyl-galactosamine, N-acetyl-glucosamine, fucose, galactose, and the like.

In particular embodiments, a heparan sulfate (HS) or heparin binding domain is substituted into the virus capsid (for example, in an AAV capsid that otherwise does not bind to HS or heparin). It is known in the art that HS/heparin binding is mediated by a "basic patch" that is rich in arginines and/or lysines. In exemplary embodiments, a sequence following the motif BXXB (SEQ ID NO: 51), where "B" is a basic residue and X is neutral and/or hydrophobic can be employed. As a non-limiting example, BXXB can be RGNR (SEQ ID NO: 52). As another non-limiting example, BXXB is substituted for amino acid positions 262 through 265 in the native AAV2 capsid protein or at the corresponding position(s) in the capsid protein of another AAV serotype.

Table 6 shows other non-limiting examples of suitable targeting sequences.

TABLE 6

SUITABLE TARGETING SEQUENCES

| Sequence NO | SEQ ID | Reference |
|---|---|---|
| NSVRDL(G/S) | 53 | Muller et al., Nature Biotechnology 21: 1040-1046 (2003) |
| PRSVTVP | 54 | Muller et al., Nature Biotechnology 21: 1040-1046 (2003) |
| NSVSSX(S/A) | 55 | Muller et al., Nature Biotechnology 21: 1040-1046 (2003) |
| NGRAHA | 56 | Grifman et al., Molecular Therapy 3:964-975 (2001) |
| QPEHSST | 57 | Work et al., Molecular Therapy 13:683-693 (2006) |
| VNTANST | 58 | Work et al., Molecular Therapy 13:683-693 (2006) |
| HGPMQS | 59 | Work et al., Molecular Therapy 13:683-693 (2006) |
| PHKPPLA | 60 | Work et al., Molecular Therapy 13:683-693 (2006) |
| IKNNEMW | 61 | Work et al., Molecular Therapy 13:683-693 (2006) |
| RNLDTPM | 62 | Work et al., Molecular Therapy 13:683-693 (2006) |
| VDSHRQS | 63 | Work et al., Molecular Therapy 13:683-693 (2006) |
| YDSKTKT | 64 | Work et al., Molecular Therapy 13:683-693 (2006) |
| SQLPHQK | 65 | Work et al., Molecular Therapy 13:683-693 (2006) |
| STMQQNT | 66 | Work et al., Molecular Therapy 13:683-693 (2006) |
| TERYMTQ | 67 | Work et al., Molecular Therapy 13:683-693 (2006) |
| QPEHSST | 68 | Work et al., Molecular Therapy 13:683-693 (2006) |
| DASLSTS | 69 | Work et al., Molecular Therapy 13:683-693 (2006) |
| DLPNKT | 70 | Work et al., Molecular Therapy 13:683-693 (2006) |
| DLTAARL | 71 | Work et al., Molecular Therapy 13:683-693 (2006) |

TABLE 6-continued

SUITABLE TARGETING SEQUENCES

| Sequence NO | SEQ ID | Reference |
|---|---|---|
| EPHQFNY | 72 | Work et al., Molecular Therapy 13:683-693 (2006) |
| EPQSNHT | 73 | Work et al., Molecular Therapy 13:683-693 (2006) |
| MSSWPSQ | 74 | Work et al., Molecular Therapy 13:683-693 (2006) |
| NPKHNAT | 75 | Work et al., Molecular Therapy 13:683-693 (2006) |
| PDGMRTT | 76 | Work et al., Molecular Therapy 13:683-693 (2006) |
| PNNNKTT | 77 | Work et al., Molecular Therapy 13:683-693 (2006) |
| QSTTHDS | 78 | Work et al., Molecular Therapy 13:683-693 (2006) |
| TGSKQKQ | 79 | Work et al., Molecular Therapy 13:683-693 (2006) |
| SLKHQAL | 80 | Work et al., Molecular Therapy 13:683-693 (2006) |
| SPIDGEQ | 81 | Work et al., Molecular Therapy 13:683-693 (2006) |
| WIFPWIQL | 82 | Hajitou et al., TCM 16:80-88 (2006) |
| CDCRGDCFC | 83 | Hajitou et al., TCM 16:80-88 (2006) |
| CNGRC | 84 | Hajitou et al., TCM 16:80-88 (2006) |
| CPRECES | 85 | Hajitou et al., TCM 16:80-88 (2006) |
| CTTHWGFTLC | 86 | Hajitou et al., TCM 16:80-88 (2006) |
| CGRRAGGSC | 87 | Hajitou et al., TCM 16:80-88 (2006) |
| CKGGRAKDC | 88 | Hajitou et al., TCM 16:80-88 (2006) |
| CVPELGHEC | 89 | Hajitou et al., TCM 16:80-88 (2006) |
| CRRETAWAK | 90 | Koivunen et al., J. Nucl. Med. 40:883-888 (1999) |
| VSWFSHRYSPFAVS | 91 | Koivunen et al., J. Nucl. Med. 40:883-888 (1999) |
| GYRDGYAGPILYN | 92 | Koivunen et al., J. Nucl. Med. 40:883-888 (1999) |
| XXXY*XXX | 93 | Koivunen et al., J. Nucl. Med. 40:883-888 (1999) |
| Y*E/MNW | 94 | Koivunen et al., J. Nucl. Med. 40:883-888 (1999) |
| RPLPPLP | 95 | Koivunen et al., J. Nucl. Med. 40:883-888 (1999) |
| APPLPPR | 96 | Koivunen et al., J. Nucl. Med. 40:883-888 (1999) |
| DVFYPYPYASGS | 97 | Koivunen et al., J. Nucl. Med. 40:883-888 (1999) |
| MYWYPY | 98 | Koivunen et al., J. Nucl. Med. 40:883-888 (1999) |
| DITWDQLWDLMK | 99 | Koivunen et al., J. Nucl. Med. 40:883-888 (1999) |
| CWDD(G/L)WLC | 100 | Koivunen et al., J. Nucl. Med. 40:883-888 (1999) |
| EWCEYLGGYLRCYA | 101 | Koivunen et al., J. Nucl. Med. 40:883-888 (1999) |
| YXCXXGPXTVVXCXP | 102 | Koivunen et al., J. Nucl. Med. 40:883-888 (1999) |
| IEGPTLRQWLAARA | 103 | Koivunen et al., J. Nucl. Med. 40:883-888 (1999) |
| LWXX(Y/W/F/H) | 104 | Koivunen et al., J. Nucl. Med. 40:883-888 (1999) |
| XFXXYLW | 105 | Koivunen et al., J. Nucl. Med. 40:883-888 (1999) |
| RWGLCD | 1060 | Koivunen et al., J. Nucl. Med. 40:883-888 (1999) |
| MSRPACPPNDKYE | 107 | Koivunen et al., J. Nucl. Med. 40:883-888 (1999) |

TABLE 6-continued

SUITABLE TARGETING SEQUENCES

| Sequence NO | SEQ ID | Reference |
|---|---|---|
| CLRSGRGC | 108 | Koivunen et al., J. Nucl. Med. 40:883-888 (1999) |
| CHWMFSPWC | 109 | Koivunen et al., J. Nucl. Med. 40:883-888 (1999) |
| WXXF | 110 | Koivunen et al., J. Nucl. Med. 40:883-888 (1999) |
| CSSRLDAC | 111 | Koivunen et al., J. Nucl. Med. 40:883-888 (1999) |
| CLPVASC | 112 | Koivunen et al., J. Nucl. Med. 40:883-888 (1999) |
| CGFECVRQCPERC | 113 | Koivunen et al., J. Nucl. Med. 40:883-888 (1999) |
| CVALCREACGEGC | 114 | Koivunen et al., J. Nucl. Med. 40:883-888 (1999) |
| SWCEPGWCR | 115 | Koivunen et al., J. Nucl. Med. 40:883-888 (1999) |
| YSGWGW | 116 | Koivunen et al., J. Nucl. Med. 40:883-888 (1999) |
| GLSGGRS | 117 | Koivunen et al., J. Nucl. Med. 40:883-888 (1999) |
| LMLPRAD | 118 | Koivunen et al., J. Nucl. Med. 40:883-888 (1999) |
| CSCFRDVCC | 119 | Koivunen et al., J. Nucl. Med. 40:883-888 (1999) |
| CRDVVSVIC | 120 | Koivunen et al., J. Nucl. Med. 40:883-888 (1999) |
| CNGRC | 121 | Koivunen et al., J. Nucl. Med. 40:883-888 (1999) |
| MARSGL | 122 | Newton & Deutscher, Phage Peptide Display in Handbook of Experimental Pharmacology, pages 145-163, Springer-Verlag, Berlin (2008) |
| MARAKE | 123 | Newton & Deutscher, Phage Peptide Display in Handbook of Experimental Pharmacology, pages 145-163, Springer-Verlag, Berlin (2008) |
| MSRTMS | 124 | Newton & Deutscher, Phage Peptide Display in Handbook of Experimental Pharmacology, pages 145-163, Springer-Verlag, Berlin (2008) |
| KCCYSL | 125 | Newton & Deutscher, Phage Peptide Display in Handbook of Experimental Pharmacology, pages 145-163, Springer-Verlag, Berlin (2008) |
| MYWGDSHWLQYWYE | 126 | Newton & Deutscher, Phage Peptide Display in Handbook of Experimental Pharmacology, pages 145-163, Springer-Verlag, Berlin (2008) |
| MQLPLAT | 127 | Newton & Deutscher, Phage Peptide Display in Handbook of Experimental Pharmacology, pages 145-163, Springer-Verlag, Berlin (2008) |
| EWLS | 128 | Newton & Deutscher, Phage Peptide Display in Handbook of Experimental Pharmacology, pages 145-163, Springer-Verlag, Berlin (2008) |
| SNEW | 129 | Newton & Deutscher, Phage Peptide Display in Handbook of Experimental Pharmacology, pages 145-163, Springer-Verlag, Berlin (2008) |
| TNYL | 130 | Newton & Deutscher, Phage Peptide Display in Handbook of Experimental Pharmacology, pages 145-163, Springer-Verlag, Berlin (2008) |
| WIFPWIQL | 131 | Newton & Deutscher, Phage Peptide Display in Handbook of Experimental Pharmacology, pages 145-163, Springer-Verlag, Berlin (2008) |
| WDLAWMFRLPVG | 132 | Newton & Deutscher, Phage Peptide Display in Handbook of Experimental Pharmacology, pages 145-163, Springer-Verlag, Berlin (2008) |
| CTVALPGGYVRVC | 133 | Newton & Deutscher, Phage Peptide Display in Handbook of Experimental Pharmacology, pages 145-163, Springer-Verlag, Berlin (2008) |

TABLE 6-continued

SUITABLE TARGETING SEQUENCES

| Sequence NO | SEQ ID | Reference |
|---|---|---|
| CVPELGHEC | 134 | Newton & Deutscher, Phage Peptide Display in Handbook of Experimental Pharmacology, pages 145-163, Springer-Verlag, Berlin (2008) |
| CGRRAGGSC | 135 | Newton & Deutscher, Phage Peptide Display in Handbook of Experimental Pharmacology, pages 145-163, Springer-Verlag, Berlin (2008) |
| CVAYCIEHHCWTC | 136 | Newton & Deutscher, Phage Peptide Display in Handbook of Experimental Pharmacology, pages 145-163, Springer-Verlag, Berlin (2008) |
| CVFAHNYDYLVC | 137 | Newton & Deutscher, Phage Peptide Display in Handbook of Experimental Pharmacology, pages 145-163, Springer-Verlag, Berlin (2008) |
| CVFTSNYAFC | 138 | Newton & Deutscher, Phage Peptide Display in Handbook of Experimental Pharmacology, pages 145-163, Springer-Verlag, Berlin (2008) |
| VHSPNKK | 139 | Newton & Deutscher, Phage Peptide Display in Handbook of Experimental Pharmacology, pages 145-163, Springer-Verlag, Berlin (2008) |
| CDCRGDCFC | 140 | Newton & Deutscher, Phage Peptide Display in Handbook of Experimental Pharmacology, pages 145-163, Springer-Verlag, Berlin (2008) |
| CRGDGWC | 141 | Newton & Deutscher, Phage Peptide Display in Handbook of Experimental Pharmacology, pages 145-163, Springer-Verlag, Berlin (2008) |
| XRGCDX | 142 | Newton & Deutscher, Phage Peptide Display in Handbook of Experimental Pharmacology, pages 145-163, Springer-Verlag, Berlin (2008) |
| PXX(S/T) | 143 | Newton & Deutscher, Phage Peptide Display in Handbook of Experimental Pharmacology, pages 145-163, Springer-Verlag, Berlin (2008) |
| CTTHWGFTLC | 144 | Newton & Deutscher, Phage Peptide Display in Handbook of Experimental Pharmacology, pages 145-163, Springer-Verlag, Berlin (2008) |
| SGKGPRQITAL | 145 | Newton & Deutscher, Phage Peptide Display in Handbook of Experimental Pharmacology, pages 145-163, Springer-Verlag, Berlin (2008) |
| A(A/Q)(N/A)(L/Y)(T/V/M/R)(R/K) | 146 | Newton & Deutscher, Phage Peptide Display in Handbook of Experimental Pharmacology, pages 145-163, Springer-Verlag, Berlin (2008) |
| VYMSPF | 147 | Newton & Deutscher, Phage Peptide Display in Handbook of Experimental Pharmacology, pages 145-163, Springer-Verlag, Berlin (2008) |
| MQLPLAT | 148 | Newton & Deutscher, Phage Peptide Display in Handbook of Experimental Pharmacology, pages 145-163, Springer-Verlag, Berlin (2008) |
| ATWLPPR | 149 | Newton & Deutscher, Phage Peptide Display in Handbook of Experimental Pharmacology, pages 145-163, Springer-Verlag, Berlin (2008) |
| HTMYYHHYQHHL | 150 | Newton & Deutscher, Phage Peptide Display in Handbook of Experimental Pharmacology, pages 145-163, Springer-Verlag, Berlin (2008) |
| SEVGCRAGPLQWLCEKYFG | 151 | Newton & Deutscher, Phage Peptide Display in Handbook of Experimental Pharmacology, pages 145-163, Springer-Verlag, Berlin (2008) |
| CGLLPVGRPDRNVWRWLC | 152 | Newton & Deutscher, Phage Peptide Display in Handbook of Experimental Pharmacology, pages 145-163, Springer-Verlag, Berlin (2008) |

TABLE 6-continued

SUITABLE TARGETING SEQUENCES

| Sequence NO | SEQ ID | Reference |
|---|---|---|
| CKGQCDRFKGLPWEC | 153 | Newton & Deutscher, Phage Peptide Display in Handbook of Experimental Pharmacology, pages 145-163, Springer-Verlag, Berlin (2008) |
| SGRSA | 154 | Newton & Deutscher, Phage Peptide Display in Handbook of Experimental Pharmacology, pages 145-163, Springer-Verlag, Berlin (2008) |
| WGFP | 155 | Newton & Deutscher, Phage Peptide Display in Handbook of Experimental Pharmacology, pages 145-163, Springer-Verlag, Berlin (2008) |
| LVVXXAr | 156 | Newton & Deutscher, Phage Peptide Display in Handbook of Experimental Pharmacology, pages 145-163, Springer-Verlag, Berlin (2008) |
| XFXXYLW | 157 | Newton & Deutscher, Phage Peptide Display in Handbook of Experimental Pharmacology, pages 145-163, Springer-Verlag, Berlin (2008) |
| AEPMPHSLNFSQYLWYT | 158 | Newton & Deutscher, Phage Peptide Display in Handbook of Experimental Pharmacology, pages 145-163, Springer-Verlag, Berlin (2008) |
| WAY(W/F)SP | 159 | Newton & Deutscher, Phage Peptide Display in Handbook of Experimental Pharmacology, pages 145-163, Springer-Verlag, Berlin (2008) |
| IELLQAR | 160 | Newton & Deutscher, Phage Peptide Display in Handbook of Experimental Pharmacology, pages 145-163, Springer-Verlag, Berlin (2008) |
| DITWDQLWDLMK | 161 | Newton & Deutscher, Phage Peptide Display in Handbook of Experimental Pharmacology, pages 145-163, Springer-Verlag, Berlin (2008) |
| AYTKCSRQWRTCMTTH | 162 | Newton & Deutscher, Phage Peptide Display in Handbook of Experimental Pharmacology, pages 145-163, Springer-Verlag, Berlin (2008) |
| PQNSKIPGPTFLDPH | 163 | Newton & Deutscher, Phage Peptide Display in Handbook of Experimental Pharmacology, pages 145-163, Springer-Verlag, Berlin (2008) |
| SMEPALPDWWWKMFK | 164 | Newton & Deutscher, Phage Peptide Display in Handbook of Experimental Pharmacology, pages 145-163, Springer-Verlag, Berlin (2008) |
| ANTPCGPYTHDCPVKR | 165 | Newton & Deutscher, Phage Peptide Display in Handbook of Experimental Pharmacology, pages 145-163, Springer-Verlag, Berlin (2008) |
| TACHQHVRMVRP | 166 | Newton & Deutscher, Phage Peptide Display in Handbook of Experimental Pharmacology, pages 145-163, Springer-Verlag, Berlin (2008) |
| VPWMEPAYQRFL | 167 | Newton & Deutscher, Phage Peptide Display in Handbook of Experimental Pharmacology, pages 145-163, Springer-Verlag, Berlin (2008) |
| DPRATPGS | 168 | Newton & Deutscher, Phage Peptide Display in Handbook of Experimental Pharmacology, pages 145-163, Springer-Verlag, Berlin (2008) |
| FRPNRAQDYNTN | 169 | Newton & Deutscher, Phage Peptide Display in Handbook of Experimental Pharmacology, pages 145-163, Springer-Verlag, Berlin (2008) |
| CTKNSYLMC | 170 | Newton & Deutscher, Phage Peptide Display in Handbook of Experimental Pharmacology, pages 145-163, Springer-Verlag, Berlin (2008) |
| C(R/Q)L/RT(G/N)XXG(A/V)GC | 171 | Newton & Deutscher, Phage Peptide Display in Handbook of Experimental Pharmacology, pages 145-163, Springer-Verlag, Berlin (2008) |

TABLE 6-continued

SUITABLE TARGETING SEQUENCES

| Sequence NO | SEQ ID | Reference |
|---|---|---|
| CPIEDRPMC | 172 | Newton & Deutscher, Phage Peptide Display in Handbook of Experimental Pharmacology, pages 145-163, Springer-Verlag, Berlin (2008) |
| HEWSYLAPYPWF | 173 | Newton & Deutscher, Phage Peptide Display in Handbook of Experimental Pharmacology, pages 145-163, Springer-Verlag, Berlin (2008) |
| MCPKHPLGC | 174 | Newton & Deutscher, Phage Peptide Display in Handbook of Experimental Pharmacology, pages 145-163, Springer-Verlag, Berlin (2008) |
| RMWPSSTVNLSAGRR | 175 | Newton & Deutscher, Phage Peptide Display in Handbook of Experimental Pharmacology, pages 145-163, Springer-Verlag, Berlin (2008) |
| SAKTAVSQRVWLPSHRGGEP | 176 | Newton & Deutscher, Phage Peptide Display in Handbook of Experimental Pharmacology, pages 145-163, Springer-Verlag, Berlin (2008) |
| KSREHVNNSACPSKRITAAL | 177 | Newton & Deutscher, Phage Peptide Display in Handbook of Experimental Pharmacology, pages 145-163, Springer-Verlag, Berlin (2008) |
| EGFR | 178 | Newton & Deutscher, Phage Peptide Display in Handbook of Experimental Pharmacology, pages 145-163, Springer-Verlag, Berlin (2008) |
| AGLGVR | 179 | Newton & Deutscher, Phage Peptide Display in Handbook of Experimental Pharmacology, pages 145-163, Springer-Verlag, Berlin (2008) |
| GTRQGHTMRLGVSDG | 180 | Newton & Deutscher, Phage Peptide Display in Handbook of Experimental Pharmacology, pages 145-163, Springer-Verlag, Berlin (2008) |
| IAGLATPGWSHWLAL | 181 | Newton & Deutscher, Phage Peptide Display in Handbook of Experimental Pharmacology, pages 145-163, Springer-Verlag, Berlin (2008) |
| SMSIARL | 182 | Newton & Deutscher, Phage Peptide Display in Handbook of Experimental Pharmacology, pages 145-163, Springer-Verlag, Berlin (2008) |
| HTFEPGV | 183 | Newton & Deutscher, Phage Peptide Display in Handbook of Experimental Pharmacology, pages 145-163, Springer-Verlag, Berlin (2008) |
| NTSLKRISNKR1RRK | 184 | Newton & Deutscher, Phage Peptide Display in Handbook of Experimental Pharmacology, pages 145-163, Springer-Verlag, Berlin (2008) |
| LRIKRKRRKRKKTRK | 185 | Newton & Deutscher, Phage Peptide Display in Handbook of Experimental Pharmacology, pages 145-163, Springer-Verlag, Berlin (2008) |

As yet a further embodiment, the targeting sequence may be a peptide that can be used for chemical coupling (e.g., can comprise arginine and/or lysine residues that can be chemically coupled through their R groups) to another molecule that targets entry into a cell.

As another embodiment, the AAV capsid protein or virus capsid of the disclosure can comprise a mutation as described in WO 2006/066066. For example, the capsid protein can comprise a selective amino acid substitution at amino acid position 263, 705, 708 and/or 716 of the native AAV2 capsid protein or a corresponding change(s) in a capsid protein from another AAV serotype.

Additionally, or alternatively, in representative embodiments, the capsid protein, virus capsid or vector comprises a selective amino acid insertion directly following amino acid position 264 of the AAV2 capsid protein or a corresponding change in the capsid protein from other AAV. By "directly following amino acid position X" it is intended that the insertion immediately follows the indicated amino acid position (for example, "following amino acid position 264" indicates a point insertion at position 265 or a larger insertion, e.g., from positions 265 to 268, etc.).

Furthermore, in representative embodiments, the capsid protein, virus capsid or vector of this disclosure can comprise amino acid modifications such as described in PCT Publication No. WO 2010/093784 (e.g., 2i8) and/or in PCT Publication No. WO 2014/144229 (e.g., dual glycan).

In some embodiments of this disclosure, the capsid protein, virus capsid or vector of this disclosure can have equivalent or enhanced transduction efficiency relative to the transduction efficiency of the AAV serotype from which the capsid protein, virus capsid or vector of this disclosure originated. In some embodiments of this disclosure, the capsid protein, virus capsid or vector of this disclosure can have reduced transduction efficiency relative to the transduction efficiency of the AAV serotype from which the capsid protein, virus capsid or vector of this disclosure originated. In some embodiments of this disclosure, the capsid protein, virus capsid or vector of this disclosure can have equivalent or enhanced tropism relative to the tropism of the AAV serotype from which the capsid protein, virus capsid or vector of this disclosure originated. In some embodiments of this disclosure, the capsid protein, virus capsid or vector of this disclosure can have an altered or different tropism relative to the tropism of the AAV serotype from which the capsid protein, virus capsid or vector of this disclosure originated. In some embodiments of this disclosure, the capsid protein, virus capsid or vector of this disclosure can have or be engineered to have tropism for brain tissue. In some embodiments of this disclosure, the capsid protein, virus capsid or vector of this disclosure can have or be engineered to have tropism for liver tissue.

The foregoing embodiments can be used to deliver a heterologous nucleic acid to a cell or subject as described herein. For example, the modified vector can be used to treat a lysosomal storage disorder such as a mucopolysaccharidosis disorder (e.g., Sly syndrome [β-glucuronidase], Hurler Syndrome [alpha-L-iduronidase], Scheie Syndrome [alpha-L-iduronidase], Hurler-Scheie Syndrome [alpha-L-iduronidase], Hunter's Syndrome [iduronate sulfatase], Sanfilippo Syndrome A [heparan sulfamidase], B [N-acetylglucosaminidase], C [acetyl-CoA:alpha-glucosaminide acetyltransferase], D [N-acetylglucosamine 6-sulfatase], Morquio Syndrome A [galactose-6-sulfate sulfatase], B [β-galactosidase], Maroteaux-Lamy Syndrome [N-acetylgalactosamine-4-sulfatase], etc.), Fabry disease (a-galactosidase), Gaucher's disease (glucocerebrosidase), or a glycogen storage disorder (e.g., Pompe disease; lysosomal acid alpha-glucosidase) as described herein.

Those skilled in the art will appreciate that for some AAV capsid proteins the corresponding modification will be an insertion and/or a substitution, depending on whether the corresponding amino acid positions are partially or completely present in the virus or, alternatively, are completely absent.

The disclosure also encompasses virus vectors comprising the modified capsid proteins and capsids of the disclosure. In particular embodiments, the virus vector is a parvovirus vector (e.g., comprising a parvovirus capsid and/or vector genome), for example, an AAV vector (e.g., comprising an AAV capsid and/or vector genome). In representative embodiments, the virus vector comprises a modified AAV capsid comprising a modified capsid subunit of the disclosure and a vector genome.

For example, in representative embodiments, the virus vector comprises: (a) a modified virus capsid (e.g., a modified AAV capsid) comprising a modified capsid protein of the disclosure; and (b) a nucleic acid comprising a terminal repeat sequence (e.g., an AAV TR), wherein the nucleic acid comprising the terminal repeat sequence is encapsidated by the modified virus capsid. The nucleic acid can optionally comprise two terminal repeats (e.g., two AAV TRs).

In representative embodiments, the virus vector is a recombinant virus vector comprising a heterologous nucleic acid encoding a polypeptide or functional RNA of interest. Recombinant virus vectors are described in more detail below.

In particular embodiments, the virus vectors of the disclosure (i) have reduced transduction of liver as compared with the level of transduction by a virus vector without the modified capsid protein; (ii) exhibit enhanced systemic transduction by the virus vector in an animal subject as compared with the level observed by a virus vector without the modified capsid protein; (iii) demonstrate enhanced movement across endothelial cells as compared with the level of movement by a virus vector without the modified capsid protein, and/or (iv) exhibit a selective enhancement in transduction of an ophthalmic tissue (e.g., retinal pigment epithelium), (v) exhibit a selective enhancement in transduction of liver tissue, and/or (vi) reduced transduction of brain tissues (e.g., neurons) as compared with the level of transduction by a virus vector without the modified capsid protein.

It will be understood by those skilled in the art that the modified capsid proteins, virus capsids and virus vectors of the disclosure exclude those capsid proteins, capsids and virus vectors that have the indicated amino acids at the specified positions in their native state (i.e., are not mutants).

Methods of Producing Virus Vectors

The present disclosure further provides methods of producing the virus vectors described herein. Thus, in one embodiment, the present disclosure provides a method of producing an AAV vector that has enhanced tropism to a target tissue of interest (e.g. an ophthalmic tissue), comprising: a) identifying amino acid residues that form a three dimensional surface-exposed loop on an AAV capsid protein; b) generating a library of AAV capsid proteins comprising amino acid substitutions of the amino acid residues identified in (a); c) producing AAV particles comprising capsid proteins from the library of AAV capsid proteins of (b); d) contacting the AAV particles of (c) with cells under conditions whereby infection and replication can occur; e) selecting AAV particles that can complete at least one infectious cycle and replicate to titers similar to control AAV particles: 1) contacting the AAV particles selected in (e) with cells of a target tissue of interest under conditions whereby infection and replication can occur; and g) selecting AAV particles that transduce the target tissue of interest. Non-limiting examples of methods for identifying surface-exposed loop amino acid residues include peptide epitope mapping and/or cryo-electron microscopy.

Resolution and identification of the surface-exposed loop residues within the three dimensional surface-exposed loop allows for their subsequent modification through random, rational and/or degenerate mutagenesis to generate AAV capsids with desirable transduction patterns that can be identified through further selection and/or screening.

Thus, in a further embodiment, the present disclosure provides a method of producing an AAV vector that has an enhanced transduction profile with respect to a target tissue of interest, comprising: a) identifying amino acid residues that form a three dimensional surface-exposed loop on an AAV capsid protein; b) generating AAV capsid proteins comprising amino acid substitutions of the surface-exposed loop amino acid residues identified in (a) by random, rational and/or degenerate mutagenesis; c) producing AAV particles comprising capsid proteins from the AAV capsid proteins of (b); d) contacting the AAV particles of (c) with cells under conditions whereby infection and replication can occur; e) selecting AAV particles that can complete at least one infectious cycle and replicate to titers similar to control AAV particles; f) contacting the AAV particles selected in (e) with cells of a target tissue of interest under conditions whereby infection and replication can occur; and g) selecting AAV particles that transduce the target tissue of interest.

Nonlimiting examples of methods for identifying surface-exposed loop amino acid residues include peptide epitope mapping and/or cryo-electron microscopy. Methods of generating AAV capsid proteins comprising amino acid substitutions of surface loop amino acid residues by random, rational and/or degenerate mutagenesis are known in the art.

This comprehensive approach presents a platform technology that can be applied to modifying any AAV capsid. Application of this platform technology yields AAV variants derived from the original AAV capsid template that have desirable transduction efficiency. As one advantage and benefit, application of this technology will expand the cohort of patients eligible for gene therapy with AAV vectors.

In one embodiment, the present disclosure provides a method of producing a virus vector, the method comprising providing to a cell: (a) a nucleic acid template comprising at least one TR sequence (e.g., AAV TR sequence), and (b) AAV sequences sufficient for replication of the nucleic acid template and encapsidation into AAV capsids (e.g., AAV rep sequences and AAV cap sequences encoding the AAV capsids of the disclosure). Optionally, the nucleic acid template further comprises at least one heterologous nucleic acid sequence. In particular embodiments, the nucleic acid template comprises two AAV ITR sequences, which are located 5' and 3' to the heterologous nucleic acid sequence (if present), although they need not be directly contiguous thereto.

The nucleic acid template and AAV rep and cap sequences are provided under conditions such that virus vector comprising the nucleic acid template packaged within the AAV capsid is produced in the cell. The method can further comprise the step of collecting the virus vector from the cell. The virus vector can be collected from the medium and/or by lysing the cells.

The cell can be a cell that is permissive for AAV viral replication. Any suitable cell known in the art may be employed. In particular embodiments, the cell is a mammalian cell. As another option, the cell can be a trans-complementing packaging cell line that provides functions deleted from a replication-defective helper virus, e.g., 293 cells or other E1a trans-complementing cells.

The AAV replication and capsid sequences may be provided by any method known in the art. Current protocols typically express the AAV rep/cap genes on a single plasmid. The AAV replication and packaging sequences need not be provided together, although it may be convenient to do so. The AAV rep and/or cap sequences may be provided by any viral or non-viral vector. For example, the rep/cap sequences may be provided by a hybrid adenovirus or herpesvirus vector (e.g., inserted into the E1a or E3 regions of a deleted adenovirus vector). EBV vectors may also be employed to express the AAV cap and rep genes. One advantage of this method is that EBV vectors are episomal, yet will maintain a high copy number throughout successive cell divisions (i.e., are stably integrated into the cell as extra-chromosomal elements, designated as an "EBV based nuclear episome," see Margolski, (1992) Curr. Top. Microbiol. Immun. 158:67).

As a further alternative, the rep/cap sequences may be stably incorporated into a cell.

Typically the AAV rep/cap sequences will not be flanked by the TRs, to prevent rescue and/or packaging of these sequences.

The nucleic acid template can be provided to the cell using any method known in the art. For example, the template can be supplied by a non-viral (e.g., plasmid) or viral vector. In particular embodiments, the nucleic acid template is supplied by a herpesvirus or adenovirus vector (e.g., inserted into the E1a or E3 regions of a deleted adenovirus). As another illustration, Palombo et al., (1998) J. Virology 72:5025, describes a baculovirus vector carrying a reporter gene flanked by the AAV TRs. EBV vectors may also be employed to deliver the template, as described above with respect to the rep/cap genes.

In another representative embodiment, the nucleic acid template is provided by a replicating rAAV virus. In still other embodiments, an AAV provirus comprising the nucleic acid template is stably integrated into the chromosome of the cell.

To enhance virus titers, helper virus functions (e.g., adenovirus or herpesvirus) that promote a productive AAV infection can be provided to the cell. Helper virus sequences necessary for AAV replication are known in the art. Typically, these sequences will be provided by a helper adenovirus or herpesvirus vector. Alternatively, the adenovirus or herpesvirus sequences can be provided by another non-viral or viral vector, e.g., as a noninfectious adenovirus miniplasmid that carries all of the helper genes that promote efficient AAV production as described by Ferrari et al., (1997) Nature Med. 3: 1295, and U.S. Pat. Nos. 6,040,183 and 6,093,570.

Further, the helper virus functions may be provided by a packaging cell with the helper sequences embedded in the chromosome or maintained as a stable extrachromosomal element. Generally, the helper virus sequences cannot be packaged into AAV virions, e.g., are not flanked by TRs.

Those skilled in the art will appreciate that it may be advantageous to provide the AAV replication and capsid sequences and the helper virus sequences (e.g., adenovirus sequences) on a single helper construct. This helper construct may be a non-viral or viral construct. As one nonlimiting illustration, the helper construct can be a hybrid adenovirus or hybrid herpesvirus comprising the AAV rep/cap genes.

In one particular embodiment, the AAV rep/cap sequences and the adenovirus helper sequences are supplied by a single adenovirus helper vector. This vector further can comprise the nucleic acid template. The AAV rep/cap sequences and/or the rAAV template can be inserted into a deleted region (e.g., the E1a or E3 regions) of the adenovirus.

In a further embodiment, the AAV rep/cap sequences and the adenovirus helper sequences are supplied by a single adenovirus helper vector. According to this embodiment, the rAAV template can be provided as a plasmid template.

In another illustrative embodiment, the AAV rep/cap sequences and adenovirus helper sequences are provided by a single adenovirus helper vector, and the rAAV template is integrated into the cell as a provirus. Alternatively, the rAAV template is provided by an EBV vector that is maintained within the cell as an extrachromosomal element (e.g., as an EBV based nuclear episome).

In a further exemplary embodiment, the AAV rep/cap sequences and adenovirus helper sequences are provided by a single adenovirus helper. The rAAV template can be provided as a separate replicating viral vector. For example, the rAAV template can be provided by a rAAV particle or a second recombinant adenovirus particle.

According to the foregoing methods, the hybrid adenovirus vector typically comprises the adenovirus 5' and 3' cis sequences sufficient for adenovirus replication and packaging (i.e., the adenovirus terminal repeats and PAC sequence).

The AAV rep/cap sequences and, if present, the rAAV template are embedded in the adenovirus backbone and are flanked by the 5' and 3' cis sequences, so that these sequences may be packaged into adenovirus capsids. As described above, the adenovirus helper sequences and the AAV rep/cap sequences are generally not flanked by TRs so that these sequences are not packaged into the AAV virions.

Zhang et al., ((2001) Gene Ther. 18:704-12) describe a chimeric helper comprising both adenovirus and the AAV rep and cap genes.

Herpesvirus may also be used as a helper virus in AAV packaging methods. Hybrid herpesviruses encoding the AAV Rep protein(s) may advantageously facilitate scalable AAV vector production schemes. A hybrid herpes simplex virus type I (HSV-1) vector expressing the AAV-2 rep and cap genes has been described (Conway et al., (1999) Gene Therapy 6:986 and WO 00/17377.

As a further alternative, the virus vectors of the disclosure can be produced in insect cells using baculovirus vectors to deliver the rep/cap genes and rAAV template as described, for example, by Urabe et al., (2002) Human Gene Therapy 13: 1935-43.

AAV vector stocks free of contaminating helper virus may be obtained by any method known in the art. For example, AAV and helper virus may be readily differentiated based on size. AAV may also be separated away from helper virus based on affinity for a heparin substrate (Zolotukhin et al. (1999) Gene Therapy 6:973). Deleted replication-defective helper viruses can be used so that any contaminating helper virus is not replication competent. As a further alternative, an adenovirus helper lacking late gene expression may be employed, as only adenovirus early gene expression is required to mediate packaging of AAV virus. Adenovirus mutants defective for late gene expression are known in the art (e.g., ts100K and ts149 adenovirus mutants).

Recombinant Virus Vectors

The virus vectors of the present disclosure are useful for the delivery of nucleic acids to cells in vitro, ex vivo, and in vivo. In particular, the virus vectors can be advantageously employed to deliver or transfer nucleic acids to animal, including mammalian, cells. Thus, in some embodiments, a nucleic acid ("cargo nucleic acid") may be encapsidated by a capsid protein of the disclosure.

In some embodiments, the disclosure provides an AAV vector comprising a recombinant capsid protein with at least 90%, at least 95%, at least 96%, at least 97%, at least 98%, at least 99%, or 100% sequence identity, with any one of SEQ ID NO: 11-12, 23-49, or 195-254. In some embodiments, an AAV vector comprising a recombinant capsid protein with at least 90%, at least 95%, at least 96%, at least 97%, at least 98%, at least 99%, or 100% sequence identity, with any one of SEQ ID NO: 32, 35, 37, or 40. In some embodiments, an AAV viral vector comprises a recombinant capsid protein with at least 90%, at least 95%, at least 96%, at least 97%, at least 98%, at least 99%, or 100% sequence identity, with any one of SEQ ID NO: 11-12, 23-49, or 195-254 and further comprises a cargo nucleic acid encapsidated by the capsid protein. In some embodiments, an AAV viral vector comprises a recombinant capsid protein with at least 90%, at least 95%, at least 96%, at least 97%, at least 98%, at least 99%, or 100% sequence identity, with any one of SEQ ID NO: 32, 35, 37, or 40 and further comprises a cargo nucleic acid encapsidated by the capsid protein. In some embodiments, the AAV vectors specifically target and infect a tissue of the eye (such as the RPE or the retina). In some embodiments, the AAV vectors display enhanced transduction to the eye (e.g., the RPE or the retina) compared to a parental AAV capsid.

The cargo nucleic acid sequence delivered in the virus vectors of the present disclosure may be any heterologous nucleic acid sequence(s) of interest. Nucleic acids of interest include nucleic acids encoding polypeptides, including therapeutic (e.g., for medical or veterinary uses) or immunogenic (e.g., for vaccines) polypeptides or RNAs.

Therapeutic polypeptides include, but are not limited to, cystic fibrosis transmembrane regulator protein (CFTR), dystrophin (including mini- and micro-dystrophins, see, e.g., Vincent et al, (1993) Nature Genetics 5: 130; U.S. Patent Publication No. 2003/017131; International publication WO/2008/088895, Wang et al., Proc. Natl. Acad. Sci. USA 97: 1 3714-13719 (2000); and Gregorevic et al., Mol. Ther. 16:657-64 (2008)), myostatin propeptide, follistatin, activin type 11 soluble receptor, IGF-1, apolipoproteins such as apoA (apoA1, apoA2, apoA4, apoA-V), apoB (apoB100, ApoB48), apoC (apoCI, apoCII, apoCIII, apoCIV), apoD, apoE, apoH, apoL, apo(a), anti-inflammatory polypeptides such as the Ikappa B dominant mutant, amyloid beta, tau, sarcospan, utrophin (Tinsley et al, (1996) Nature 384:349), mini-utrophin, clotting factors (e.g., Factor VIII, Factor IX, Factor X, etc.), erythropoietin, angiostatin, endostatin, catalase, tyrosine hydroxylase, superoxide dismutase, leptin, the LDL receptor, lipoprotein lipase, progranulin, ornithine transcarbamylase, β-globin, α-globin, spectrin, alpha-1-antitrypsin, adenosine deaminase, hypoxanthine guanine phosphoribosyl transferase, β-glucocerebrosidase, battenin, sphingomyelinase, lysosomal hexosaminidase A, branched-chain keto acid dehydrogenase, frataxin, RP65 protein, cytokines (e.g., alpha-interferon, beta-interferon, gamma-interferon, interleukin-2, interleukin-4, alpha synuclein, parkin, granulocyte-macrophage colony stimulating factor, lymphotoxin, and the like), peptide growth factors, neurotrophic factors and hormones (e.g., somatotropin, insulin, insulin-like growth factors 1 and 2, platelet derived growth factor, epidermal growth factor, fibroblast growth factor, nerve growth factor, neurotrophic factor-3 and -4, brain-derived neurotrophic factor, bone morphogenic proteins [including RANKL and VEGF], glial derived growth factor, transforming growth factor-α and -β, and the like), huntingtin, lysosomal acid alpha-glucosidase, iduronate-2-sulfatase, N-sulfoglucosamine sulfohydrolase, alpha-galactosidase A, receptors (e.g., the tumor necrosis growth factor soluble receptor), S100A1, ubiquitin protein ligase E3, parvalbumin, adenylyl cyclase type 6, a molecule that modulates calcium handling (e.g., SERCA2A, Inhibitor 1 of PP1 and fragments thereof [e.g., WO 2006/029319 and WO 2007/100465]), a molecule that effects G-protein coupled receptor kinase type 2 knockdown such as a truncated constitutively active bARKct, anti-inflammatory factors such as IRAP, anti-myostatin proteins, aspartoacylase, monoclonal antibodies (including single chain monoclonal antibodies; an exemplary Mab is the Herceptin® Mab), neuropeptides and fragments thereof (e.g., galanin, Neuropeptide Y (see, U.S. Pat. No. 7,071,172), angiogenesis inhibitors such as Vasohibins and other VEGF inhibitors (e.g., Vasohibin 2 [see, WO JP2006/073052]). Other illustrative heterologous nucleic acid sequences encode suicide gene products (e.g., thymidine kinase, cytosine deaminase, diphtheria toxin, and tumor necrosis factor), proteins that enhance or inhibit transcription of host factors (e.g., nuclease-dead Cas9 linked to a transcription enhancer or inhibitor element, zinc-finger proteins linked to a transcription enhancer or inhibitor element, transcription activator-like (TAL) effectors linked to a transcription enhancer or inhibitor element), proteins conferring resistance to a drug used in cancer therapy, tumor suppressor gene products (e.g., p53, Rb, Wt-1), TRAIL, FAS-ligand, RS1, opsin, TKR-beta, C3, CFH, and any other polypeptide that has a therapeutic effect in a subject in need thereof. In some embodiments, an AAV vector may be used to deliver a complement protein such as C21a, C4b, C3a, C3b, C5a, C5b, C6, C7, C8, or C9. AAV vectors can also be used to deliver monoclonal antibodies and antibody fragments, for example, an antibody or antibody fragment directed against myostatin (see, e.g., Fang et al., Nature Biotechnology 23:584-590 (2005)). Heterologous nucleic acid sequences encoding polypeptides include those encoding reporter polypeptides (e.g., an enzyme). Reporter polypeptides are known in the art and include, but are not limited to, Green Fluorescent Protein, 3-galactosidase, alkaline phosphatase, luciferase, and chloramphenicol acetyltransferase gene.

Optionally, the heterologous nucleic acid encodes a secreted polypeptide (e.g., a polypeptide that is a secreted polypeptide in its native state or that has been engineered to be secreted, for example, by operable association with a secretory signal sequence as is known in the art).

Alternatively, in particular embodiments of this disclosure, the heterologous nucleic acid may encode an antisense nucleic acid, a ribozyme (e.g., as described in U.S. Pat. No. 5,877,022), RNAs that effect spliceosome-mediated/ram-splicing (see, Puttaraju et al, (1999) Nature Biotech. 17:246; U.S. Pat. Nos. 6,013,487; 6,083,702), interfering RNAs (RNAi) including siRNA, shRNA or miRNA that mediate gene silencing (see, Sharp et al, (2000) Science 287:2431), and other non-translated RNAs, such as "guide" RNAs (Gorman et al., (1998) Proc. Nat. Acad. Sci. USA 95:4929; U.S. Pat. No. 5,869,248 to Yuan et al.), and the like. Exemplary untranslated RNAs include RNAi against a multiple drug resistance (MDR) gene product (e.g., to treat and/or prevent tumors and/or for administration to the heart to prevent damage by chemotherapy), RNAi against myostatin (e.g., for Duchenne muscular dystrophy), RNAi against VEGF (e.g., to treat and/or prevent tumors), RNAi against phospholamban (e.g., to treat cardiovascular disease, see, e.g., Andino et al., J. Gene Med. 10: 132-142 (2008) and Li et al., Acta Pharmacol Sin. 26:51-55 (2005)); phospholamban inhibitory or dominant-negative molecules such as phospholamban S 16E (e.g., to treat cardiovascular disease, see, e.g., Hoshijima et al. Nat. Med. 8:864-871 (2002)), RNAi to adenosine kinase (e.g., for epilepsy), and RNAi directed against pathogenic organisms and viruses (e.g., hepatitis B and/or C virus, human immunodeficiency virus, CMV, herpes simplex virus, human papilloma virus, etc.).

Further, a nucleic acid sequence that directs alternative splicing can be delivered. To illustrate, an antisense sequence (or other inhibitory sequence) complementary to the 5' and/or 3' splice site of dystrophin exon 51 can be delivered in conjunction with a U1 or U7 small nuclear (sn) RNA promoter to induce skipping of this exon. For example, a DNA sequence comprising a U1 or U7 snRNA promoter located 5' to the antisense/inhibitory sequence(s) can be packaged and delivered in a modified capsid of the disclosure.

In some embodiments, a nucleic acid sequence that directs gene editing can be delivered. For example, the nucleic acid may encode a guide RNA. In some embodiments, the guide RNA is a single guide RNA (sgRNA) comprising a crRNA sequence and a tracrRNA sequence. In some embodiments, the nucleic acid may encode a nuclease. In some embodiments, the nuclease is a zinc-finger nuclease, a homing endonuclease, a TALEN (transcription activator-like effector nuclease), a NgAgo (agronaute endonuclease), a SGN (structure-guided endonuclease), a RGN (RNA-guided nuclease), or modified or truncated variants thereof. In some embodiments, the RNA-guided nuclease is a Cas9 nuclease, a Cas12(a) nuclease (Cpf1), a Cas12b nuclease, a Cas12c nuclease, a TrpB-like nuclease, a Cas13a nuclease (C2c2), a Cas13b nuclease, a Cas14 nuclease, or modified or truncated variants thereof. In some embodiments, the Cas9 nuclease is isolated or derived from S. pyogenes or S. aureus.

In some embodiments, a nucleic acid sequence that directs gene knockdown can be delivered. For example, the nucleic acid sequence may encode a siRNA, an shRNA, a microRNA, or an antisense nucleic acid. The virus vector may also comprise a heterologous nucleic acid that shares homology with and recombines with a locus on a host chromosome. This approach can be utilized, for example, to correct a genetic defect in the host cell.

The virus vector may also comprise a heterologous nucleic acid that shares homology with and recombines with a locus on a host chromosome. This approach can be utilized, for example, to correct a genetic defect in the host cell.

The present disclosure also provides virus vectors that express an immunogenic polypeptide, e.g., for vaccination. The nucleic acid may encode any immunogen of interest known in the art including, but not limited to, immunogens from human immunodeficiency virus (HIV), simian immunodeficiency virus (SIV), influenza virus, HIV or SIV gag proteins, tumor antigens, cancer antigens, bacterial antigens, viral antigens, and the like.

The use of parvoviruses as vaccine vectors is known in the art (see, e.g., Miyamura el al, (1994) Proc. Nat. Acad. Sci USA 91:8507; U.S. Pat. No. 5,916,563 to Young et al, U.S. Pat. No. 5,905,040 to Mazzara et al, U.S. Pat. Nos. 5,882,652, 5,863,541 to Samulski et al). The antigen may be presented in the parvovirus capsid.

Alternatively, the antigen may be expressed from a heterologous nucleic acid introduced into a recombinant vector genome. Any immunogen of interest as described herein and/or as is known in the art can be provided by the virus vector of the present disclosure.

An immunogenic polypeptide can be any polypeptide suitable for eliciting an immune response and/or protecting the subject against an infection and/or disease, including, but not limited to, microbial, bacterial, protozoal, parasitic, fungal and/or viral infections and diseases. For example, the immunogenic polypeptide can be an orthomyxovirus immunogen (e.g., an influenza virus immunogen, such as the influenza virus hemagglutinin (HA) surface protein or the influenza virus nucleoprotein, or an equine influenza virus immunogen) or a lentivirus immunogen (e.g., an equine infectious anemia virus immunogen, a Simian Immunodeficiency Virus (SIV) immunogen, or a Human Immunodeficiency Virus (HIV) immunogen, such as the HIV or SIV envelope GP 160 protein, the HIV or SIV matrix/capsid proteins, and the HIV or SIV gag, pol and env genes products). The immunogenic polypeptide can also be an arenavirus immunogen (e.g., Lassa fever virus immunogen, such as the Lassa fever virus nucleocapsid protein and the Lassa fever envelope glycoprotein), a poxvirus immunogen (e.g., a vaccinia virus immunogen, such as the vaccinia LI or L8 gene products), a flavivirus immunogen (e.g., a yellow fever virus immunogen or a Japanese encephalitis virus immunogen), a filovirus immunogen (e.g., an Ebola virus immunogen, or a Marburg virus immunogen, such as NP and GP gene products), a bunyavirus immunogen (e.g., RVFV, CCHF, and/or SFS virus immunogens), or a coronavirus immunogen (e.g., an infectious human coronavirus immunogen, such as the human coronavirus envelope glycoprotein, or a porcine transmissible gastroenteritis virus immunogen, or an avian infectious bronchitis virus immunogen). The immunogenic polypeptide can further be a polio immunogen, a herpes immunogen (e.g., CMV, EBV, HSV immunogens), a mumps immunogen, a measles immunogen, a rubella immunogen, a diphtheria toxin or other diphtheria immunogen, a pertussis antigen, a hepatitis (e.g., hepatitis A, hepatitis B, hepatitis C, etc.) immunogen, and/or any other vaccine immunogen now known in the art or later identified as an immunogen.

Alternatively, the immunogenic polypeptide can be any tumor or cancer cell antigen. Optionally, the tumor or cancer antigen is expressed on the surface of the cancer cell.

Exemplary cancer and tumor cell antigens are described in S. A. Rosenberg (Immunity 10:281 (1991)). Other illustrative cancer and tumor antigens include, but are not limited to: BRCA1 gene product, BRCA2 gene product, gp100, tyrosinase, GAGE-1/2, BALE, RAGE, LAGE, NY-ESO-1, CDK-4, β-catenin, MUM-1, Caspase-8, KIAA0205, HPVE, SART-1, FRAME, p15, melanoma tumor antigens (Kawakami et al., (1994) Proc. Natl. Acad. Sci. USA 91:3515; Kawakami et al., (1994) J. Exp. Med., 180:347; Kawakami et al., (1994) Cancer Res. 54:3124), MART-1, gp100, MAGE-1, MAGE-2, MAGE-3, CEA, TRP-1, TRP-2, P-15, tyrosinase (Brichard et al., (1993) J Exp. Med. 178:489); HER-2/neu gene product (U.S. Pat. No. 4,968,603), CA 125, LK26, FB5 (endosialin), TAG 72, AFP, CA 19-9, NSE, DU-PAN-2, CA50, SPan-1, CA72-4, HCG, STN (sialyl Tn antigen), c-erbB-2 proteins, PSA, L-CanAg, estrogen receptor, milk fat globulin, p53 tumor suppressor protein (Levine, (1993) Ann. Rev. Biochem. 62:623); mucin antigens (International Patent Publication No. WO 90/05142); telomerases; nuclear matrix proteins; prostatic acid phosphatase; papilloma virus antigens; and/or antigens now known or later discovered to be associated with the following cancers: melanoma, adenocarcinoma, thymoma, lymphoma (e.g., non-Hodgkin's lymphoma, Hodgkin's lymphoma), sarcoma, lung cancer, liver cancer, colon cancer, leukemia, uterine cancer, breast cancer, prostate cancer, ovarian cancer, cervical cancer, bladder cancer, kidney cancer, pancreatic cancer, brain cancer and any other cancer or malignant condition or metastasis thereof now known or later identified (see, e.g., Rosenberg, (1996) Ann. Rev. Med. 47:481-91).

As a further alternative, the heterologous nucleic acid can encode any polypeptide that is desirably produced in a cell in vitro, ex vivo, or in vivo. For example, the virus vectors may be introduced into cultured cells and the expressed gene product isolated therefrom.

It will be understood by those skilled in the art that the heterologous nucleic acid(s) of interest can be operably associated with appropriate control sequences. For example, the heterologous nucleic acid can be operably associated with expression control elements, such as transcription/translation control signals, origins of replication, polyadenylation signals, internal ribosome entry sites (IRES), promoters, and/or enhancers, and the like.

Further, regulated expression of the heterologous nucleic acid(s) of interest can be achieved at the post-transcriptional level, e.g., by regulating selective splicing of different introns by the presence or absence of an oligonucleotide, small molecule and/or other compound that selectively blocks splicing activity at specific sites (e.g., as described in WO 2006/119137).

Those skilled in the art will appreciate that a variety of promoter/enhancer elements can be used depending on the level and tissue-specific expression desired. The promoter/enhancer can be constitutive or inducible, depending on the pattern of expression desired. The promoter/enhancer can be native or foreign and can be a natural or a synthetic sequence. By foreign, it is intended that the transcriptional initiation region is not found in the wild-type host into which the transcriptional initiation region is introduced.

In particular embodiments, the promoter/enhancer elements can be native to the target cell or subject to be treated. In representative embodiments, the promoters/enhancer element can be native to the heterologous nucleic acid sequence. The promoter/enhancer element is generally chosen so that it functions in the target cell(s) of interest. Further, in particular embodiments the promoter/enhancer element is a mammalian promoter/enhancer element. The promoter/enhancer element may be constitutive or inducible.

Inducible expression control elements are typically advantageous in those applications in which it is desirable to provide regulation over expression of the heterologous nucleic acid sequence(s). Inducible promoters/enhancer elements for gene delivery can be tissue-specific or -preferred promoter/enhancer elements, and include muscle specific or preferred (including cardiac, skeletal and/or smooth muscle specific or preferred), neural tissue specific or preferred (including brain-specific or preferred), eye specific or preferred (including retina-specific and cornea-specific), liver specific or preferred, bone marrow specific or preferred, pancreatic specific or preferred, spleen specific or preferred, and lung specific or preferred promoter/enhancer elements. Other inducible promoter/enhancer elements include hormone-inducible and metal-inducible elements. Exemplary inducible promoters/enhancer elements include, but are not limited to, a Tet on/off element, a RU486-inducible promoter, an ecdysone-inducible promoter, a rapamycin-inducible promoter, and a metallothionein promoter.

In embodiments wherein the heterologous nucleic acid sequence(s) is transcribed and then translated in the target cells, specific initiation signals are generally included for efficient translation of inserted protein coding sequences. These exogenous translational control sequences, which may include the ATG initiation codon and adjacent sequences, can be of a variety of origins, both natural and synthetic.

The virus vectors according to the present disclosure provide a means for delivering heterologous nucleic acids into a broad range of cells, including dividing and non-dividing cells. The virus vectors can be employed to deliver a nucleic acid of interest to a cell in vitro, e.g., to produce a polypeptide in vitro or for ex vivo gene therapy. The virus vectors are additionally useful in a method of delivering a nucleic acid to a subject in need thereof e.g., to express an immunogenic or therapeutic polypeptide or a functional RNA. In this manner, the polypeptide or functional RNA can be produced in vivo in the subject. The subject can be in need of the polypeptide because the subject has a deficiency of the polypeptide. Further, the method can be practiced because the production of the polypeptide or functional RNA in the subject may impart some beneficial effect.

The virus vectors can also be used to produce a polypeptide of interest or functional RNA in cultured cells or in a subject (e.g., using the subject as a bioreactor to produce the polypeptide or to observe the effects of the functional RNA on the subject, for example, in connection with screening methods).

In general, the virus vectors of the present disclosure can be employed to deliver a heterologous nucleic acid encoding a polypeptide or functional RNA to treat and/or prevent any disease state for which it is beneficial to deliver a therapeutic polypeptide or functional RNA. Illustrative disease states include, but are not limited to: cystic fibrosis (cystic fibrosis transmembrane regulator protein) and other diseases of the lung, hemophilia A (Factor VIII), hemophilia B (Factor IX), thalassemia (β-globin), anemia (erythropoietin) and other blood disorders. Alzheimer's disease (GDF; neprilysin), multiple sclerosis (β-interferon), Parkinson's disease (glial-cell line derived neurotrophic factor [GDNF]), Huntington's disease (RNAi to remove repeats), Canavan's disease, amyotrophic lateral sclerosis, epilepsy (galanin, neurotrophic factors), and other neurological disorders, cancer (endostatin, angiostatin, TRAIL, FAS-ligand, cytokines including interferons; RNAi including RNAi against VEGF or the multiple drug resistance gene product, mir-26a [e.g., for hepatocellular carcinoma]), diabetes mellitus (insulin), muscular dystrophies including Duchenne (dystrophin, mini-dystrophin, insulin-like growth factor I, a sarcoglycan [e.g., α, β, γ], RNAi against myostatic myostatin propeptide, follistatin, activin type II soluble receptor, anti-inflammatory polypeptides such as the Ikappa B dominant mutant, sarcospan, utrophin, mini-utrophin, antisense or RNAi against splice junctions in the dystrophin gene to induce exon skipping [see, e.g., WO/2003/095647], antisense against U7 snRNAs to induce exon skipping [see, e.g., WO/2006/021724], and antibodies or antibody fragments against myostatin or myostatin propeptide) and Becker muscular dystrophy, Myotonic dystrophy 1 or 2, facioscapulohumeral muscular dystrophy (FSHD), Gaucher disease (glucocerebrosidase), Hurler's disease (a-L-iduronidase), adenosine deaminase deficiency (adenosine deaminase), glycogen storage diseases (e.g., Fabry disease [a-galactosidase] and Pompe disease [lysosomal acid alpha-glucosidase]) and other metabolic disorders, congenital emphysema (alpha-1-antitrypsin), Lesch-Nyhan Syndrome (hypoxan thine guanine phosphoribosyl transferase), Niemann-Pick disease (sphingomyelinase), Tay-Sachs disease (lysosomal hexosaminidase A), frontotemporal dementia, Maple Syrup Urine Disease (branched-chain keto acid dehydrogenase), retinal degenerative diseases (and other diseases of the eye and retina; e.g., PDGF for macular degeneration and/or vasohibin or other inhibitors of VEGF or other angiogenesis inhibitors to treat/prevent retinal disorders, e.g., in Type I diabetes), diseases of solid organs such as brain (including Parkinson's Disease [GDNF], astrocytomas [endostatin, angiostatin and/or RNAi against VEGF], glioblastomas [endostatin, angiostatin and/or RNAi against VEGF]), liver, kidney, heart including congestive heart failure or peripheral artery disease (PAD) (e.g., by delivering protein phosphatase inhibitor I (1-1) and fragments thereof (e.g., 11C), serca2a, zinc finger proteins that regulate the phospholamban gene, Barkct, β2-adrenergic receptor, 2-adrenergic receptor kinase (BARK), phosphoinositide-3 kinase (PI3 kinase), S100A1, parvalbumin, adenylyl cyclase type 6, a molecule that effects G-protein coupled receptor kinase type 2 knockdown such as a truncated constitutively active bARKct; calsarcin, RNAi against phospholamban; phospholamban inhibitory or dominant-negative molecules such as phospholamban S16E, etc.), arthritis (insulin-like growth factors), joint disorders (insulin-like growth factor 1 and/or 2), intimal hyperplasia (e.g., by delivering enos, inos), improve survival of heart transplants (superoxide dismutase), AIDS (soluble CD4), muscle wasting (insulin-like growth factor 1), kidney deficiency (erythropoietin), anemia (erythropoietin), arthritis (anti-inflammatory factors such as I RAP and TNFa soluble receptor), hepatitis (a-interferon), LDL receptor deficiency (LDL receptor), hyperammonemia (ornithine transcarbamylase), Krabbe's disease (galactocerebrosidase), Batten's disease, spinal cerebral ataxias including SCA1, SCA2 and SCA3, phenylketonuria (phenylalanine hydroxylase), autoimmune diseases, and the like. The disclosure can further be used following organ transplantation to increase the success of the transplant and/or to reduce the negative side effects of organ transplantation or adjunct therapies (e.g., by administering immunosuppressant agents or inhibitory nucleic acids to block cytokine production). As another example, bone morphogenic proteins (including BNP 2, 7, etc., RANKL and/or VEGF) can be administered with a bone allograft, for example, following a break or surgical removal in a cancer patient.

In some embodiments, the virus vectors of the present disclosure can be employed to deliver a heterologous nucleic acid encoding a polypeptide or functional RNA to treat and/or prevent a liver disease or disorder. The liver disease or disorder may be, for example, primary biliary cirrhosis, nonalcoholic fatty liver disease (NAFLD), non-alcoholic steatohepatitis (NASH), autoimmune hepatitis, hepatitis B, hepatitis C, alcoholic liver disease, fibrosis, jaundice, primary sclerosing cholangitis (PSC), Budd-Chiari syndrome, hemochromatosis, Wilson's disease, alcoholic fibrosis, non-alcoholic fibrosis, liver steatosis, Gilbert's syndrome, biliary atresia, alpha-1-antitrypsin deficiency, alagille syndrome, progressive familial intrahepatic cholestasis, Hemophilia B, Hereditary Angioedema (HAE), Homozygous Familial Hypercholesterolemia (HoFH), Heterozygous Familial Hypercholesterolemia (HeFH), Von Gierke's Disease (GSD I), Hemophilia A, Methylmalonic Acidemia, Propionic Acidemia, Homocystinuria, Phenylketonuria (PKU), Tyrosinemia Type 1, Arginase 1 Deficiency, Argininosuccinate Lyase Deficiency, Carbamoyl-phosphate synthetase 1 deficiency, Citrullinemia Type 1, Citrin Deficiency, Crigler-Najjar Syndrome Type 1, Cystinosis, Fabry Disease, Glycogen Storage Disease 1b, LPL Deficiency, N-Acetylglutamate Synthetase Deficiency, Ornithine Transcarbamylase Deficiency, Ornithine Translocase Deficiency, Primary Hyperoxaluria Type 1, or ADA SCID.

The disclosure can also be used to produce induced pluripotent stem cells (iPS). For example, a virus vector of the disclosure can be used to deliver stem cell associated nucleic acid(s) into a non-pluripotent cell, such as adult fibroblasts, skin cells, liver cells, renal cells, adipose cells, cardiac cells, neural cells, epithelial cells, endothelial cells, and the like.

Nucleic acids encoding factors associated with stem cells are known in the art. Nonlimiting examples of such factors associated with stem cells and pluripotency include Oct-3/4, the SOX family (e.g., SOX 1, SOX2, SOX3 and/or SOX 15), the Klf family (e.g., Klfl, KHZ Klf4 and/or Klf5), the Myc family (e.g., C-myc, L-myc and/or N-myc), NANOG and/or LIN28.

The disclosure can also be practiced to treat and/or prevent a metabolic disorder such as diabetes (e.g., insulin), hemophilia (e.g., Factor IX or Factor VIII), a lysosomal storage disorder such as a mucopolysaccharidosis disorder (e.g., Sly syndrome [β-glucuronidase] Hurler Syndrome [alpha-L-iduronidase], Scheie Syndrome [alpha-L-iduronidase], Hurler-Scheie Syndrome [alpha-L-iduronidase], Hunter's Syndrome [iduronate sulfatase], Sanfilippo Syndrome A [heparan sulfamidase], B [N-acetylglucosaminidase], C [acetyl-CoA:alpha-glucosaminide acetyltransferase], D [N-acetylglucosamine 6-sulfatase], Morquio Syndrome A [galactoses-sulfate sulfatase], B [β-galactosidase], Maroteaux-Lamy Syndrome [N-acetylgalactosamine-4-sulfatase], etc.), Fabry disease (alpha-galactosidase), Gaucher's disease (glucocerebrosidase), or a glycogen storage disorder (e.g., Pompe disease; lysosomal acid alpha-glucosidase).

Gene transfer has substantial use for understanding and providing therapy for disease states. There are a number of inherited diseases in which defective genes are known and have been cloned. In general, the above disease states fall into two classes: deficiency states, usually of enzymes, which are generally inherited in a recessive manner, and unbalanced states, which may involve regulatory or structural proteins, and which are typically inherited in a dominant manner. For deficiency state diseases, gene transfer can be used to bring a normal gene into affected tissues for replacement therapy, as well as to create animal models for the disease using antisense mutations. For unbalanced disease states, gene transfer can be used to create a disease state in a model system, which can then be used in efforts to counteract the disease state. Thus, virus vectors according to the present disclosure permit the treatment and/or prevention of genetic diseases.

The virus vectors according to the present disclosure may also be employed to provide a functional RNA to a cell in vitro or in vivo. The functional RNA may be, for example, a non-coding RNA. In some embodiments, expression of the functional RNA in the cell can diminish expression of a particular target protein by the cell. Accordingly, functional RNA can be administered to decrease expression of a particular protein in a subject in need thereof. In some embodiments, expression of the functional RNA in the cell can increase expression of a particular target protein by the cell. Accordingly, functional RNA can be administered to increase expression of a particular protein in a subject in need thereof. In some embodiments, expression of the functional RNA can regulate splicing of a particular target RNA in a cell. Accordingly, functional RNA can be administered to regulate splicing a particular RNA in a subject in need thereof. In some embodiments, expression of the functional RNA in the cell can regulate the function of a particular target protein by the cell. Accordingly, functional RNA can be administered to regulate the function of a particular protein in a subject in need thereof. Functional RNA can also be administered to cells in vitro to regulate gene expression and/or cell physiology, e.g., to optimize cell or tissue culture systems or in screening methods.

In addition, virus vectors according to the instant disclosure find use in diagnostic and screening methods, whereby a nucleic acid of interest is transiently or stably expressed in a cell culture system, or alternatively, a transgenic animal model.

The virus vectors of the present disclosure can also be used for various non-therapeutic purposes, including but not limited to use in protocols to assess gene targeting, clearance, transcription, translation, etc., as would be apparent to one skilled in the art. The virus vectors can also be used for the purpose of evaluating safety (spread, toxicity, immunogenicity, etc.). Such data, for example, are considered by the United States Food and Drug Administration as part of the regulatory approval process prior to evaluation of clinical efficacy.

As a further aspect, the virus vectors of the present disclosure may be used to produce an immune response in a subject. According to this embodiment, a virus vector comprising a heterologous nucleic acid sequence encoding an immunogenic polypeptide can be administered to a subject, and an active immune response is mounted by the subject against the immunogenic polypeptide. Immunogenic polypeptides are as described hereinabove. In some embodiments, a protective immune response is elicited.

Alternatively, the virus vector may be administered to a cell ex vivo and the altered cell is administered to the subject. The virus vector comprising the heterologous nucleic acid is introduced into the cell, and the cell is administered to the subject, where the heterologous nucleic acid encoding the immunogen can be expressed and induce an immune response in the subject against the immunogen. In particular embodiments, the cell is an antigen-presenting cell (e.g., a dendritic cell).

An "active immune response" or "active immunity" is characterized by "participation of host tissues and cells after an encounter with the immunogen. It involves differentiation and proliferation of immunocompetent cells in lymphoreticular tissues, which lead to synthesis of antibody or the development of cell-mediated reactivity, or both." Herbert B. Herscowitz, Immunophysiology: Cell Function and Cellular Interactions in Antibody Formation, in IMMUNOLOGY: BASIC PROCESSES 117 (Joseph A. Bellanti ed., 1985). Alternatively stated, an active immune response is mounted by the host after exposure to an immunogen by infection or by vaccination. Active immunity can be contrasted with passive immunity, which is acquired through the transfer of preformed substances (antibody, transfer factor, thymic graft, interleukin-2) from an actively immunized host to a non-immune host.

A "protective" immune response or "protective" immunity as used herein indicates that the immune response confers some benefit to the subject in that it prevents or reduces the incidence of disease. Alternatively, a protective immune response or protective immunity may be useful in the treatment and/or prevention of disease, in particular cancer or tumors (e.g., by preventing cancer or tumor formation, by causing regression of a cancer or tumor and/or by preventing metastasis and/or by preventing growth of metastatic nodules). The protective effects may be complete or partial, as long as the benefits of the treatment outweigh any disadvantages thereof.

In particular embodiments, the virus vector or cell comprising the heterologous nucleic acid can be administered in an immunogenically effective amount, as described below.

The virus vectors of the present disclosure can also be administered for cancer immunotherapy by administration of a virus vector expressing one or more cancer cell antigens (or an immunologically similar molecule) or any other immunogen that produces an immune response against a cancer cell. To illustrate, an immune response can be produced against a cancer cell antigen in a subject by administering a virus vector comprising a heterologous nucleic acid encoding the cancer cell antigen, for example to treat a patient with cancer and/or to prevent cancer from developing in the subject. The virus vector may be administered to a subject in vivo or by using ex vivo methods, as described herein.

Alternatively, the cancer antigen can be expressed as part of the virus capsid or be otherwise associated with the virus capsid (e.g., as described above).

As another alternative, any other therapeutic nucleic acid (e.g., RNAi) or polypeptide (e.g., cytokine) known in the art can be administered to treat and/or prevent cancer.

As used herein, the term "cancer" encompasses tumor-forming cancers. Likewise, the term "cancerous tissue" encompasses tumors. A "cancer cell antigen" encompasses tumor antigens.

The term "cancer" has its understood meaning in the art, for example, an uncontrolled growth of tissue that has the potential to spread to distant sites of the body (i.e., metastasize). Exemplary cancers include, but are not limited to melanoma, adenocarcinoma, thymoma, lymphoma (e.g., non-Hodgkin's lymphoma, Hodgkin's lymphoma), sarcoma, lung cancer, liver cancer, colon cancer, leukemia, uterine cancer, breast cancer, prostate cancer, ovarian cancer, cervical cancer, bladder cancer, kidney cancer, pancreatic cancer, brain cancer and any other cancer or malignant condition now known or later identified. In representative embodiments, the disclosure provides a method of treating and/or preventing tumor-forming cancers.

The term "tumor" is also understood in the art, for example, as an abnormal mass of undifferentiated cells within a multicellular organism. Tumors can be malignant or benign. In representative embodiments, the methods disclosed herein are used to prevent and treat malignant tumors.

By the terms "treating cancer," "treatment of cancer" and equivalent terms it is intended that the severity of the cancer is reduced or at least partially eliminated and/or the progression of the disease is slowed and/or controlled and/or the disease is stabilized. In particular embodiments, these terms indicate that metastasis of the cancer is prevented or reduced or at least partially eliminated and/or that growth of metastatic nodules is prevented or reduced or at least partially eliminated.

By the terms "prevention of cancer" or "preventing cancer" and equivalent terms it is intended that the methods at least partially eliminate or reduce and/or delay the incidence and/or severity of the onset of cancer. Alternatively stated, the onset of cancer in the subject may be reduced in likelihood or probability and/or delayed.

In particular embodiments, cells may be removed from a subject with cancer and contacted with a virus vector expressing a cancer cell antigen according to the instant disclosure. The modified cell is then administered to the subject, whereby an immune response against the cancer cell antigen is elicited. This method can be advantageously employed with immunocompromised subjects that cannot mount a sufficient immune response in vivo (i.e., cannot produce enhancing antibodies in sufficient quantities).

It is known in the art that immune responses may be enhanced by immunomodulatory cytokines (e.g., alpha-interferon, beta-interferon, gamma-interferon, omega-interferon, tau-interferon, interleukin-1-alpha, interleukin-1β, interleukin-2, interleukin-3, interleukin-4, interleukin 5, interleukin-6, interleukin-7, interleukin-8, interleukin-9, interleukin-10, interleukin-11, interleukin-12, interleukin-13, interleukin-14, interleukin-18, B cell Growth factor, CD40 Ligand, tumor necrosis factor-alpha, tumor necrosis factor-β, monocyte chemoattractant protein-1, granulocyte-macrophage colony stimulating factor, and lymphotoxin). Accordingly, immunomodulatory cytokines (preferably, CTL inductive cytokines) may be administered to a subject in conjunction with the virus vector. Cytokines may be administered by any method known in the art. Exogenous cytokines may be administered to the subject, or alternatively, a nucleic acid encoding a cytokine may be delivered to the subject using a suitable vector, and the cytokine produced in vivo.

Subjects, Pharmaceutical Formulations, and Modes of Administration

Virus vectors and capsids according to the present disclosure find use in both veterinary and medical applications. Suitable subjects include both avians and mammals. The term "avian" as used herein includes, but is not limited to, chickens, ducks, geese, quail, turkeys, pheasant, parrots, parakeets, and the like. The term "mammals" as used herein includes, but is not limited to, humans, non-human primates, bovines, ovines, caprines, equines, felines, canines, lagomorphs, etc. Human subjects include neonates, infants, juveniles, adults and geriatric subjects. In some embodiments, a human subject can be less than 6 months old, less than 2 years old, less than 5 years old, less than 10 years old, 10-18 years old, 19-29 years old, 30-35 years old, 36-40 years old, or older than 40 years old.

In representative embodiments, the subject is "in need" of the methods described herein.

In particular embodiments, a pharmaceutical composition is provided comprising a virus vector and/or capsid and/or capsid protein and/or virus particle of the disclosure in a pharmaceutically acceptable carrier and, optionally, other medicinal agents, pharmaceutical agents, stabilizing agents, buffers, carriers, adjuvants, diluents, etc. For injection, the carrier will typically be a liquid. For other methods of administration, the carrier may be either solid or liquid. For inhalation administration, the carrier will be respirable, and optionally can be in solid or liquid particulate form.

By "pharmaceutically acceptable" it is meant a material that is not toxic or otherwise undesirable, i.e., the material may be administered to a subject without causing any undesirable biological effects.

One aspect of the present disclosure is a method of transferring a nucleic acid to a cell in vitro. The virus vector may be introduced into the cells at the appropriate multiplicity of infection according to standard transduction methods suitable for the particular target cells. Titers of virus vector to administer can vary, depending upon the target cell type and number, and the particular virus vector, and can be determined by those of skill in the art without undue experimentation. In representative embodiments, at least about $10^3$ infectious units, optionally at least about $10^5$ infectious units are introduced to the cell.

The cell(s) into which the virus vector is introduced can be of any type, including but not limited to neural cells (including cells of the peripheral and central nervous systems, in particular, brain cells such as neurons and oligodendrocytes), lung cells, cells of the eye (including retinal cells, retinal pigment epithelium, and corneal cells), epithelial cells (e.g., gut and respiratory epithelial cells), muscle cells (e.g., skeletal muscle cells, cardiac muscle cells, smooth muscle cells and/or diaphragm muscle cells), dendritic cells, pancreatic cells (including islet cells), hepatic cells, myocardial cells, bone cells (e.g., bone marrow stem cells), hematopoietic stem cells, spleen cells, keratinocytes, fibroblasts, endothelial cells, prostate cells, germ cells, and the like. In representative embodiments, the cell can be any progenitor cell. As a further possibility, the cell can be a stem cell (e.g., neural stem cell, liver stem cell). As still a further alternative, the cell can be a cancer or tumor cell. Moreover, the cell can be from any species of origin, as indicated above.

The virus vector can be introduced into cells in vitro for the purpose of administering the modified cell to a subject. In particular embodiments, the cells have been removed from a subject, the virus vector is introduced therein, and the cells are then administered back into the subject. Methods of removing cells from subject for manipulation ex vivo, followed by introduction back into the subject are known in the art (see, e.g., U.S. Pat. No. 5,399,346). Alternatively, the recombinant virus vector can be introduced into cells from a donor subject, into cultured cells, or into cells from any other suitable source, and the cells are administered to a subject in need thereof (i.e., a "recipient" subject).

Suitable cells for ex vivo nucleic acid delivery are as described above. Dosages of the cells to administer to a subject will vary upon the age, condition and species of the subject, the type of cell, the nucleic acid being expressed by the cell, the mode of administration, and the like. Typically, at least about $10^2$ to about $10^8$ cells or at least about $10^3$ to about $10^6$ cells will be administered per dose in a pharmaceutically acceptable carrier. In particular embodiments, the cells transduced with the virus vector are administered to the subject in a therapeutically effective amount in combination with a pharmaceutical carrier.

In some embodiments, the virus vector is introduced into a cell and the cell can be administered to a subject to elicit an immunogenic response against the delivered polypeptide (e.g., expressed as a transgene or in the capsid). Typically, a quantity of cells expressing an immunogenically effective amount of the polypeptide in combination with a pharmaceutically acceptable carrier is administered. An "immunogenically effective amount" is an amount of the expressed polypeptide that is sufficient to evoke an active immune response against the polypeptide in the subject to which the pharmaceutical formulation is administered. In particular embodiments, the dosage is sufficient to produce a protective immune response (as defined above). The degree of protection conferred need not be complete or permanent, as long as the benefits of administering the immunogenic polypeptide outweigh any disadvantages thereof.

Thus, the present disclosure provides a method of administering a nucleic acid to a cell, the method comprising contacting the cell with the virus vector, virus particle and/or composition of this disclosure.

A further aspect of the disclosure is a method of administering the virus vector, virus particle and/or virus capsid of this disclosure to a subject. Thus, the present disclosure also provides a method of delivering a nucleic acid to a subject, comprising administering to the subject a virus particle, virus vector and/or composition of this disclosure. Administration of the virus vectors, virus particles and/or capsids according to the present disclosure to a human subject or an animal in need thereof can be by any means known in the art. Optionally, the virus vector, virus particle and/or capsid is delivered in a therapeutically effective dose in a pharmaceutically acceptable carrier. In preferred embodiments, a therapeutically effective amount of the virus vector, virus particle and/or capsid is delivered.

The virus vectors and/or capsids of the disclosure can further be administered to elicit an immunogenic response (e.g., as a vaccine). Typically, immunogenic compositions of the present disclosure comprise an immunogenically effective amount of virus vector and/or capsid in combination with a pharmaceutically acceptable carrier. Optionally, the dosage is sufficient to produce a protective immune response (as defined above). The degree of protection conferred need not be complete or permanent, as long as the benefits of administering the immunogenic polypeptide outweigh any disadvantages thereof. Subjects and immunogens are as described above.

Dosages of the virus vector and/or capsid to be administered to a subject depend upon the mode of administration, the disease or condition to be treated and/or prevented, the individual subject's condition, the particular virus vector or capsid, and the nucleic acid to be delivered, and the like, and can be determined in a routine manner. Exemplary doses for achieving therapeutic effects are titers of at least about $10^5$, about $10^6$, about $10^7$, about $10^8$, about $10^9$, about $10^{10}$, about $10^{11}$, about $10^{12}$, about $10^{13}$, about $10^{14}$, about $10^{15}$ transducing units, optionally about $10^8$-$10^{13}$ transducing units.

In particular embodiments, more than one administration (e.g., two, three, four or more administrations) may be employed to achieve the desired level of gene expression over a period of various intervals, e.g., daily, weekly, monthly, yearly, etc.

Exemplary modes of administration include oral, rectal, transmucosal, intranasal, inhalation (e.g., via an aerosol), buccal (e.g., sublingual), vaginal, intrathecal, intraocular, transdermal, in utero (or in ovo), parenteral (e.g., intravenous, subcutaneous, intradermal, intramuscular [including administration to skeletal, diaphragm and/or cardiac muscle], intradermal, intrapleural, intracerebral, and intraarticular), topical (e.g., to both skin and mucosal surfaces, including airway surfaces, and transdermal administration), intralymphatic, and the like, as well as direct tissue or organ injection (e.g., to liver, skeletal muscle, cardiac muscle, diaphragm muscle or brain). Administration can also be to a tumor (e.g., in or near a tumor or a lymph node). In some embodiments, the virus vector or composition is administered to the eye of the subject, for example via an intravitreal, subretinal, subconjuctival, retrobulbar, intracameral and/or suprachoroidal route. The most suitable route in any given case will depend on the nature and severity of the condition being treated and/or prevented and on the nature of the particular vector that is being used.

Administration to skeletal muscle according to the present disclosure includes but is not limited to administration to skeletal muscle in the limbs (e.g., upper arm, lower arm, upper leg, and/or lower leg), back, neck, head (e.g., tongue), thorax, abdomen, pelvis/perineum, and/or digits. Suitable skeletal muscles include but are not limited to abductor digiti minimi (in the hand), abductor digiti minimi (in the foot), abductor hallucis, abductor ossis metatarsi quinti, abductor pollicis *brevis*, abductor pollicis longus, adductor *brevis*, adductor hallucis, adductor longus, adductor magnus, adductor pollicis, anconeus, anterior scalene, articularis genus, biceps brachii, biceps femoris, *brachialis*, brachioradialis, buccinator, coracobrachialis, corrugator supercilii, deltoid, depressor anguli oris, depressor labii inferioris, digastric, dorsal interossei (in the hand), dorsal interossei (in the foot), extensor carpi radialis *brevis*, extensor carpi radialis longus, extensor carpi ulnaris, extensor digiti minimi, extensor digitorum, extensor digitorum *brevis*, extensor digitorum longus, extensor hallucis *brevis*, extensor hallucis longus, extensor indicis, extensor pollicis *brevis*, extensor pollicis longus, flexor carpi radialis, flexor carpi ulnaris, flexor digiti minimi *brevis* (in the hand), flexor digiti minimi *brevis* (in the foot), flexor digitorum *brevis*, flexor digitorum longus, flexor digitorum *profundus*, flexor digitorum superficialis, flexor hallucis *brevis*, flexor hallucis longus, flexor pollicis *brevis*, flexor pollicis longus, *frontalis*, gastrocnemius, geniohyoid, gluteus maximus, gluteus medius, gluteus minimus, gracilis, iliocostalis cervicis, iliocostalis lumborum, iliocostalis thoracis, illiacus, inferior gemellus, inferior oblique, inferior rectus, infraspinatus, interspinalis, intertransversi, lateral pterygoid, lateral rectus, latissimus dorsi, levator anguli oris, levator labii superioris, levator labii superioris alaeque nasi, levator palpebrae superioris, levator scapulae, long rotators, longissimus capitis, longissimus cervicis, longissimus thoracis, longus capitis, longus colli, lumbricals (in the hand), lumbricals (in the foot), masseter, medial pterygoid, medial rectus, middle scalene, multifidus, mylohyoid, obliquus capitis inferior, obliquus capitis superior, obturator externus, obturator internus, occipitalis, omohyoid, opponens digiti minimi, opponens pollicis, orbicularis oculi, orbicularis oris, palmar interossei, palmaris *brevis*, palmaris longus, pectineus, pectoralis major, pectoralis minor, peroneus *brevis*, peroneus longus, peroneus tertius, *piriformis*, plantar interossei, plantaris, platysma, popliteus, posterior scalene, pronator quadratus, pronator *teres*, psoas major, quadratus femoris, quadratus plantae, rectus capitis anterior, rectus capitis lateralis, rectus capitis posterior major, rectus capitis posterior minor, rectus femoris, rhomboid major, rhomboid minor, risorius, sartorius, scalenus minimus, semimembranosus, semispinalis capitis, semispinalis cervicis, semispinalis thoracis, semitendinosus, serratus anterior, short rotators, soleus, spinalis capitis, spinalis cervicis, spinalis thoracis, splenius capitis, splenius cervicis, sternocleidomastoid, sternohyoid, sternothyroid, stylohyoid, subclavius, subscapularis, superior gemellus, superior oblique, superior rectus, supinator, supraspinatus, temporalis, tensor fascia lata, *teres* major, *teres* minor, thoracis, thyrohyoid, tibialis anterior, tibialis posterior, trapezius, triceps brachii, vastus *intermedius*, vastus lateralis, vastus *medialis*, zygomaticus major, and zygomaticus minor, and any other suitable skeletal muscle as known in the art.

The virus vector and/or capsid can be delivered to skeletal muscle by intravenous administration, intra-arterial administration, intraperitoneal administration, limb perfusion, (optionally, isolated limb perfusion of a leg and/or arm; see, e.g. Arruda et al., (2005) Blood 105: 3458-3464), and/or direct intramuscular injection. In particular embodiments, the virus vector and/or capsid is administered to a limb (arm and/or leg) of a subject (e.g., a subject with muscular dystrophy such as DMD) by limb perfusion, optionally isolated limb perfusion (e.g., by intravenous or intra-articular administration). In embodiments of the disclosure, the virus vectors and/or capsids of the disclosure can advantageously be administered without employing "hydrodynamic" techniques. Tissue delivery (e.g., to muscle) of prior art vectors is often enhanced by hydrodynamic techniques (e.g., intravenous/intravenous administration in a large volume), which increase pressure in the vasculature and facilitate the ability of the vector to cross the endothelial cell barrier. In particular embodiments, the viral vectors and/or capsids of the disclosure can be administered in the absence of hydrodynamic techniques such as high volume infusions and/or elevated intravascular pressure (e.g., greater than normal systolic pressure, for example, less than or equal to a 5%, 10%, 15%, 20%, 25% increase in intravascular pressure over normal systolic pressure). Such methods may reduce or avoid the side effects associated with hydrodynamic techniques such as edema, nerve damage and/or compartment syndrome. Administration to cardiac muscle includes administration to the left atrium, right atrium, left ventricle, right ventricle and/or septum. The virus vector and/or capsid can be delivered to cardiac muscle by intravenous administration, intra-arterial administration such as intra-aortic administration, direct cardiac injection (e.g., into left atrium, right atrium, left ventricle, right ventricle), and/or coronary artery perfusion.

Administration to diaphragm muscle can be by any suitable method including intravenous administration, intra-arterial administration, and/or intra-peritoneal administration.

Delivery to a target tissue can also be achieved by delivering a depot comprising the virus vector and/or capsid. In representative embodiments, a depot comprising the virus vector and/or capsid is implanted into skeletal, cardiac and/or diaphragm muscle tissue or the tissue can be contacted with a film or other matrix comprising the virus vector and/or capsid. Such implantable matrices or substrates are described in U.S. Pat. No. 7,201,898.

In particular embodiments, a virus vector and/or virus capsid according to the present disclosure is administered to skeletal muscle, diaphragm muscle and/or cardiac muscle (e.g., to treat and/or prevent muscular dystrophy, heart disease [for example, PAD or congestive heart failure]).

In representative embodiments, the disclosure is used to treat and/or prevent disorders of skeletal, cardiac and/or diaphragm muscle.

In a representative embodiment, a method of treating and/or preventing muscular dystrophy in a subject in need thereof is provided, the method comprising: administering a treatment or prevention effective amount of a virus vector of the disclosure to a mammalian subject, wherein the virus vector comprises a heterologous nucleic acid encoding dystrophin, a mini-dystrophin, a micro-dystrophin, myostatin propeptide, follistatin, activin type II soluble receptor, IGF-1, anti-inflammatory polypeptides such as the Ikappa B dominant mutant, sarcospan, utrophin, a micro-dystrophin, laminin-a2, alpha-sarcoglycan, beta-sarcoglycan, gamma-sarcoglycan, delta-sarcoglycan, IGF-1, an antibody or antibody fragment against myostatin or myostatin propeptide, and/or RNAi against myostatin. In particular embodiments, the virus vector can be administered to skeletal, diaphragm and/or cardiac muscle as described elsewhere herein.

Alternatively, the disclosure can be practiced to deliver a nucleic acid to skeletal, cardiac or diaphragm muscle, which is used as a platform for production of a polypeptide (e.g., an enzyme) or functional RNA (e.g., RNAi, micro RNA, antisense RNA) that normally circulates in the blood or for systemic delivery to other tissues to treat and/or prevent a disorder (e.g., a metabolic disorder, such as diabetes [e.g., insulin], hemophilia [e.g., Factor IX or Factor VIII], a mucopolysaccharide disorder [e.g., Sly syndrome, Hurler Syndrome, Scheie Syndrome, Hurler-Scheie Syndrome, Hunter's Syndrome, Sanfilippo Syndrome A, B, C, D, Morquio Syndrome, Maroteaux-Lamy Syndrome, etc.] or a lysosomal storage disorder such as Gaucher's disease [glucocerebrosidase] or Fabry disease [a-galactosidase A] or a glycogen storage disorder such as Pompe disease [lysosomal acid alpha glucosidase]). Other suitable proteins for treating and/or preventing metabolic disorders are described herein. The use of muscle as a platform to express a nucleic acid of interest is described in U.S. Patent Pub. No. US 2002/0192189.

Thus, as one aspect, the disclosure further encompasses a method of treating and/or preventing a metabolic disorder in a subject in need thereof, the method comprising: administering a treatment or prevention effective amount of a virus vector of the disclosure to skeletal muscle of a subject, wherein the virus vector comprises a heterologous nucleic acid encoding a polypeptide, wherein the metabolic disorder is a result of a deficiency and/or defect in the polypeptide. Illustrative metabolic disorders and heterologous nucleic acids encoding polypeptides are described herein. Optionally, the polypeptide is secreted (e.g., a polypeptide that is a secreted polypeptide in its native state or that has been engineered to be secreted, for example, by operable association with a secretory signal sequence as is known in the art). Without being limited by any particular theory of the disclosure, according to this embodiment, administration to the skeletal muscle can result in secretion of the polypeptide into the systemic circulation and delivery to target tissue(s). Methods of delivering virus vectors to skeletal muscle is described in more detail herein.

The disclosure can also be practiced to produce noncoding RNA, such as antisense RNA, RNAi or other functional RNA (e.g., a ribozyme) for systemic delivery.

The disclosure also provides a method of treating and/or preventing congenital heart failure or PAD in a subject in need thereof, the method comprising administering a treatment or prevention effective amount of a virus vector of the disclosure to a mammalian subject, wherein the virus vector comprises a heterologous nucleic acid encoding, for example, a sarcoplasmic endoreticulum $Ca^{2+}$-ATPase (SERCA2a), an angiogenic factor, phosphatase inhibitor 1 (1-1) and fragments thereof (e.g., 11C), RNAi against phospholamban; a phospholamban inhibitory or dominant-negative molecule such as phospholamban S16E, a zinc finger protein that regulates the phospholamban gene, beta-2-adrenergic receptor, beta-2-adrenergic receptor kinase (BARK), PI3 kinase, calsarcan, a β-adrenergic receptor kinase inhibitor (PARKct), inhibitor 1 of protein phosphatase 1 and fragments thereof (e.g., I1 C), S100A1, parvalbumin, adenylyl cyclase type 6, a molecule that effects G-protein coupled receptor kinase type 2 knockdown such as a truncated constitutively active bARKct, Pim-1, PGC-I α, SOD-1, SOD-2, EC-SOD, kallikrein. HIF, thymosin-p4, mir-1, mir-133, mir-206, mir-208 and/or mir-26a.

Injectables can be prepared in conventional forms, either as liquid solutions or suspensions, solid forms suitable for solution or suspension in liquid prior to injection, or as emulsions. Alternatively, one may administer the virus vector and/or virus capsids of the disclosure in a local rather than systemic manner, for example, in a depot or sustained-release formulation. Further, the virus vector and/or virus capsid can be delivered adhered to a surgically implantable matrix (e.g., as described in U.S. Patent Publication No. US-2004-0013645-A1).

The virus vectors and/or virus capsids disclosed herein can be administered to the lungs of a subject by any suitable means, optionally by administering an aerosol suspension of respirable particles comprised of the virus vectors and/or virus capsids, which the subject inhales. The respirable particles can be liquid or solid. Aerosols of liquid particles comprising the virus vectors and/or virus capsids may be produced by any suitable means, such as with a pressure-driven aerosol nebulizer or an ultrasonic nebulizer, as is known to those of skill in the art. See, e.g., U.S. Pat. No. 4,501,729. Aerosols of solid particles comprising the virus vectors and/or capsids may likewise be produced with any solid particulate medicament aerosol generator, by techniques known in the pharmaceutical art.

The virus vectors and virus capsids can be administered to tissues of the CNS (e.g., brain, eye) and may advantageously result in broader distribution of the virus vector or capsid than would be observed in the absence of the present disclosure.

In particular embodiments, the delivery vectors described herein may be administered to treat diseases of the CNS, including genetic disorders, neurodegenerative disorders, psychiatric disorders and tumors. Illustrative diseases of the CNS include, but are not limited to Adrenomyeloneuropathy (AMN), Alzheimer's disease, Angelman Syndrome, Parkinson's disease, Huntington's disease, Canavan disease, Leigh's disease, Refsum disease, Tourette syndrome, primary lateral sclerosis, amyotrophic lateral sclerosis, progressive muscular atrophy, Pick's disease, muscular dystrophy, multiple sclerosis, myasthenia gravis, Binswanger's disease, trauma due to spinal cord or head injury, Tay Sachs disease, GM2 Gangliosidosis, Lesch-Nyhan disease, MC4R Obesity, Metachromatic Leukodystrophy (MLD), MPS I (Hurler/Scheie), MPS IIIA (Sanfilippo A), Niemann Pick C1, Rett Syndrome, Spinal Muscular Atrophy (SMA), AADC Deficiency, Monogenic Amyotropic Lateral Sclerosis (ALS), Alpha mannosidosis, Alzheimer's Disease, Aspartylglucosaminuria, Dravet Syndrome, Giant Axonal Neuropathy, Globoid Cell Leukodystrophy (Krabbe), Glut 1 Deficiency, GM1 Gangliosidosis, Infantile Neuronal Ceroid Lipfuscinosis (INCL, Batten), Juvenile Neuronal Ceroid Lipfuscinosis (JNCL, Batten), Late Infantile Neuronal Ceroid Lipfuscinosis (LINCL, Batten), MPS II (Hunter), MPS IIIB (Sanfilippo B), MPS IIIC (Sanfilippo C), MPS IVA (Morquio Syndrome), MPS VI (Maroteaux-Lamy), Peroxisome Biogenesis Disorders (Zellweger Syndrome Spectrum), Sandhoff Disease (GM2 Gangliosidosis), Lesch-Nyhan disease, epilepsy, cerebral infarcts, psychiatric disorders including mood disorders (e.g., depression, bipolar affective disorder, persistent affective disorder, secondary mood disorder), schizophrenia, drug dependency (e.g., alcoholism and other substance dependencies), neuroses (e.g., anxiety, obsessional disorder, somatoform disorder, dissociative disorder, grief, post-partum depression), psychosis (e.g., hallucinations and delusions), dementia, paranoia, attention deficit disorder, psychosexual disorders, sleeping disorders, pain disorders, eating or weight disorders (e.g., obesity, cachexia, anorexia nervosa, and bulemia) and cancers and tumors (e.g., pituitary tumors) of the CNS.

Disorders of the CNS may include ophthalmic disorders involving the retina, posterior tract, and optic nerve. For example, such disorders may include retinitis pigmentosa, diabetic retinopathy and other retinal degenerative diseases, uveitis, age-related macular degeneration, optic neuritis, Leber's congenital amaurosis, Leber's hereditary optic neuropathy, achromatopsia, X-linked retinoschisis, optic neuritis, choroideremia, optic atrophy, retinal cone dystrophy, retinopathy, retinoblastoma, glaucoma, Bardet-Biedl syndrome, Usher syndrome, aniridia, Friedreich's ataxia, vitelliform macular dystrophy, retinoblastoma, Stargardt disease, Charcot-Marie-Tooth disease, Fuch's dystrophy, propionic acidemia, or color blindness.

Thus, in some embodiments, the present disclosure provides a method of treating an ophthalmic disorder or defect in a subject, comprising administering to the subject a viral vector of this disclosure, wherein the viral vector comprises a nucleic acid molecule that encodes a therapeutic protein or therapeutic RNA effective in treating the ophthalmic disorder or defect. In some embodiments of this method, the viral vector is administered via an intravitreal, subretinal, subconjuctival, retrobulbar, intracameral, and/or suprachoroidal route.

Most, if not all, ophthalmic diseases and disorders are associated with one or more of three types of indications: (1) angiogenesis, (2) inflammation, and (3) degeneration. The delivery vectors of the present disclosure can be employed to deliver anti-angiogenic factors; anti-inflammatory factors; factors that retard cell degeneration, promote cell sparing, or promote cell growth and combinations of the foregoing.

Diabetic retinopathy, for example, is characterized by angiogenesis. Diabetic retinopathy can be treated by delivering one or more anti-angiogenic factors either intraocularly (e.g., in the vitreous) or periocularly (e.g., in the sub-Tenon's region). One or more neurotrophic factors may also be co-delivered, either intraocularly (e.g., intravitreally) or periocularly.

Uveitis involves inflammation. One or more anti-inflammatory factors can be administered by intraocular (e.g., vitreous or anterior chamber) administration of a delivery vector of the disclosure.

Retinitis pigmentosa, by comparison, is characterized by retinal degeneration. In representative embodiments, retinitis pigmentosa can be treated by intraocular (e.g., vitreal administration) of a delivery vector encoding one or more neurotrophic factors.

Age-related macular degeneration involves both angiogenesis and retinal degeneration. This disorder can be treated by administering the delivery vectors encoding one or more neurotrophic factors intraocularly (e.g., vitreous) and/or one or more anti-angiogenic factors intraocularly or periocularly (e.g., in the sub-Tenon's region).

Glaucoma is characterized by increased ocular pressure and loss of retinal ganglion cells. Treatments for glaucoma include administration of one or more neuroprotective agents that protect cells from excitotoxic damage using the delivery vectors. Such agents include N-methyl-D-aspartate (NMDA) antagonists, cytokines, and neurotrophic factors, delivered intraocularly, optionally intravitreally.

In other embodiments, the present disclosure may be used to treat seizures, e.g., to reduce the onset, incidence or severity of seizures. The efficacy of a therapeutic treatment for seizures can be assessed by behavioral (e.g., shaking, ticks of the eye or mouth) and/or electrographic means (most seizures have signature electrographic abnormalities). Thus, the disclosure can also be used to treat epilepsy, which is marked by multiple seizures over time.

In one representative embodiment, somatostatin (or an active fragment thereof) is administered to the brain using a delivery vector of the disclosure to treat a pituitary tumor. According to this embodiment, the delivery vector encoding somatostatin (or an active fragment thereof) is administered by microinfusion into the pituitary. Likewise, such treatment can be used to treat acromegaly (abnormal growth hormone secretion from the pituitary). The nucleic acid (e.g., GenBank Accession No. J00306) and amino acid (e.g., GenBank Accession No. P01166; contains processed active peptides somatostatin-28 and somatostatin-14) sequences of somatostatins are known in the art.

In particular embodiments, the vector can comprise a secretory signal as described in U.S. Pat. No. 7,071,172.

In representative embodiments of the disclosure, the virus vector and/or virus capsid is administered to the CNS (e.g., to the brain or to the eye). The virus vector and/or capsid may be introduced into the spinal cord, brainstem (medulla oblongata, pons), midbrain (hypothalamus, thalamus, epithalamus, pituitary gland, substantia nigra, pineal gland), cerebellum, telencephalon (corpus striatum, cerebrum including the occipital, temporal, parietal and frontal lobes, cortex, basal ganglia, hippocampus and portaamygdala), limbic system, neocortex, corpus striatum, cerebrum, and inferior colliculus. The virus vector and/or capsid may also be administered to different regions of the eye such as the retina, cornea and/or optic nerve.

The virus vector and/or capsid may be delivered into the cerebrospinal fluid (e.g., by lumbar puncture) for more disperse administration of the delivery vector. The virus vector and/or capsid may further be administered intravascularly to the CNS in situations in which the blood-brain barrier has been perturbed (e.g., brain tumor or cerebral infarct).

The virus vector and/or capsid can be administered to the desired region(s) of the CNS by any route known in the art, including but not limited to, intrathecal, intra-ocular, intracerebral, intraventricular, intravenous (e.g., in the presence of a sugar such as mannitol), intranasal, intra-aural, intra-ocular (e.g., intra-vitreous, sub-retinal, anterior chamber) and peri-ocular (e.g., sub-Tenon's region) delivery as well as intramuscular delivery with retrograde delivery to motor neurons. In particular embodiments, the virus vector and/or capsid is administered in a liquid formulation by direct injection (e.g., stereotactic injection) to the desired region or compartment in the CNS. In other embodiments, the virus vector and/or capsid may be provided by topical application to the desired region or by intra-nasal administration of an aerosol formulation. Administration to the eye, may be by topical application of liquid droplets. As a further alternative, the virus vector and/or capsid may be administered as a solid, slow-release formulation (see, e.g., U.S. Pat. No. 7,201,898).

In yet additional embodiments, the virus vector can used for retrograde transport to treat and/or prevent diseases and disorders involving motor neurons (e.g., amyotrophic lateral sclerosis (ALS); spinal muscular atrophy (SMA), etc.). For example, the virus vector can be delivered to muscle tissue from which it can migrate into neurons.

The following examples, which are included herein for illustration purposes only, are not intended to be limiting.

NUMBERED EMBODIMENTS

The following numbered embodiments are included within the scope of the disclosure.

1. A recombinant adeno-associated virus (AAV) capsid protein, wherein the capsid protein comprises a substitution in a surface-exposed loop of the AAV capsid protein, wherein the substitution has a sequence of any one of SEQ ID NO: 14, 15, 16, 17, 18, 19, 20, 21, 22, 187, 188, 189, 190, 191, 192, 193, or 194.
2. The recombinant AAV capsid protein of embodiment 1, wherein the substitution has a sequence of any one of SEQ ID NO: 14, 17, 19, or 22.
3. The recombinant AAV capsid protein of embodiment 1 or 2, wherein the capsid protein comprises an amino acid sequence with at least 80% sequence identity to a capsid protein of any one of AAV1, AAV2, AAV3, AAV4, AAV5, AAV6, AAV7, AAV8, AAV9, AAV10, AAV11, AAV12, AAVrh.8, AAVrh.10, AAVrh32.33, AAVrh74, bovine AAV or avian AAV.
4. The recombinant AAV capsid protein of any one of embodiments 1-3, wherein the capsid protein comprises an amino acid sequence that has at least 90% sequence identity with any one of SEQ ID NO: 11-12, 23-49, or 195-254.
5. The recombinant AAV capsid protein of any one of embodiments 1-3, wherein the capsid comprises an amino acid sequence of any one of SEQ ID NO: 11-12, 23-49, or 195-254.
6. The recombinant AAV capsid protein of embodiment 5, wherein the capsid comprises an amino acid sequence of any one of SEQ ID NO. 32, 35, 37, or 40.
7. The recombinant AAV capsid protein of any one of embodiments 1-3, wherein the amino acid substitution replaces the amino acids in the region corresponding to amino acid positions 591-596 of SEQ ID NO. 11 or amino acids 590-595 of SEQ ID NO. 12.
8. A recombinant AAV capsid protein, wherein the capsid protein comprises a substitution comprising a sequence of six amino acids ($X^1$-$X^2$-$X^3$-$X^4$-$X^5$-$X^6$) that does not occur in the native AAV capsid protein, wherein $X^2$ is V and $X^5$ is L (SEQ ID NO: 186).
9. The recombinant AAV capsid protein of embodiment 8, wherein the substitution replaces the amino acids in the region corresponding to amino acid positions 591-596 of SEQ ID NO. 11 or amino acids 590-595 of SEQ ID NO. 12.
10. The recombinant AAV capsid protein of embodiment 8 or 9, wherein the substitution is in a surface-exposed loop of the AAV capsid protein.
11. The recombinant AAV capsid protein of any one of embodiments 8-10, wherein $X^1$ is not T, $X^3$ is not D, $X^4$ is not R, and $X^6$ is not T.
12. The recombinant AAV capsid protein of any one of embodiments 8-11, wherein $X^1$ is K, G, F, I, H, or R.
13. The recombinant AAV capsid protein of any one of embodiments 8-12, wherein $X^3$ is R, L, H, G, or N.
14. The recombinant AAV capsid protein of any one of embodiments 8-13, wherein $X^4$ is D, A, S, or V, or R.
15. The recombinant AAV capsid protein of any one of embodiments 8-14, wherein $X^6$ is F, R, P, N, or Q.
16. The recombinant AAV capsid protein of any one of embodiments 8-11, wherein $X^1$ is K, $X^3$ is R, $X^4$ is D, and $X^6$ is F.
17. The recombinant AAV capsid protein of any one of embodiments 8-11, wherein $X^1$ is R, $X^3$ is L, $X^4$ is A, and $X^6$ is R.
18. The recombinant AAV capsid protein of any one of embodiments 8-11, wherein $X^1$ is R, $X^3$ is H, $X^4$ is A, and $X^6$ is R.
19. The recombinant AAV capsid protein of any one of embodiments 8-11, wherein $X^1$ is R, $X^3$ is H, $X^4$ is S, and $X^6$ is R.
20. The recombinant AAV capsid protein of any one of embodiments 8-11, wherein $X^1$ is G, $X^3$ is G, $X^4$ is V, and $X^6$ is P.
21. The recombinant AAV capsid protein of any one of embodiments 8-11, wherein $X^1$ is F, $X^3$ is N, $X^4$ is A, and $X^6$ is N.
22. The recombinant AAV capsid protein of any one of embodiments 8-11, wherein $X^1$ is I, $X^3$ is R, $X^4$ is S, and $X^6$ is N.
23. The recombinant AAV capsid protein of any one of embodiments 8-11, wherein $X^1$ is H, $X^3$ is L, $X^4$ is R, and $X^6$ is N.
24. The recombinant AAV capsid protein of any one of embodiments 8-11, wherein $X^1$ is R, $X^3$ is L, $X^4$ is A, and $X^6$ is Q.
25. The recombinant AAV capsid protein of any one of embodiments 8-24 wherein the AAV capsid protein is of an AAV serotype selected from AAV1, AAV2, AAV3, AAV4, AAV5, AAV6, AAV7, AAV8, AAV9, AAV10, AAV11, AAV12, AAVrh.8, AAVrh.10, AAVrh32.33, AAVrh74, bovine AAV and avian AAV.
26. A recombinant AAV capsid protein comprising the amino acid sequence of any one of SEQ ID NO: 11-12, 23-49, or 195-254.
27. The recombinant AAV capsid protein of embodiment 26 comprising the amino acid sequence of SEQ ID NO: 32, 35, 37, or 40.
28. A nucleotide sequence encoding an AAV capsid protein of any one of embodiments 1-27.
29. The nucleotide sequence of embodiment 28, wherein the nucleotide sequence is a DNA sequence.
30. The nucleotide sequence of embodiment 28, wherein the nucleotide sequence is an RNA sequence.
31. An expression vector comprising the nucleotide sequence of any one of embodiments 28-30.
32. A cell comprising the nucleotide sequence of any one of embodiments 28 to 30 or the expression vector of embodiment 31.
33. A recombinant AAV viral vector comprising the capsid protein of any one of embodiments 1 to 27.
34. The recombinant AAV viral vector of embodiment 33, wherein the AAV viral vector has an enhanced transduction profile with respect to a target tissue, as compared to an AAV viral vector comprising a capsid protein that does not comprise the substitution.
35. The recombinant AAV viral vector of embodiment 34, wherein the target tissue is an ophthalmic tissue.
36. The recombinant AAV viral vector of any one of embodiments 33-35, further comprising a cargo nucleic acid encapsidated by the capsid protein.
37. The recombinant AAV viral vector of embodiment 36, wherein the cargo nucleic acid encodes a therapeutic protein or RNA.
38. The recombinant AAV viral vector of embodiment 36 or 37, wherein the cargo nucleic acid encodes one or more of the following proteins or an antibody that binds thereto: cystic fibrosis transmembrane regulator protein (CFTR), dystrophin, myostatin propeptide, follistatin, activin type 11 soluble receptor, IGF-I, Ikappa B dominant mutant, sarcospan, utrophin, mini-utrophin, Factor VIII, Factor IX, Factor X, erythropoietin, angiostatin, endostatin, catalase, tyrosine hydroxylase, superoxide dismutase, leptin, the LDL receptor, lipoprotein lipase, ornithine transcarbamylase, β-globin, α-globin. spectrin, alpha-1-antitrypsin, adenosine deaminase, hypoxanthine guanine phosphoribosyl transferase, β-glucocerebrosidase, sphingomyelinase, lysosomal hexosaminidase A, branched-chain keto acid dehydrogenase, RPE65 protein, alpha-interferon, beta-interferon, gamma-interferon, interleukin-2, interleukin-4, granulocyte-macrophage colony stimulating factor, lymphotoxin, a peptide growth factors, a neurotrophic factors, somatotropin, insulin, insulin-like growth factors 1 or 2, platelet derived growth factor, epidermal growth factor, fibroblast growth factor, nerve growth factor, neurotrophic factor-3 or -4, brain-derived neurotrophic factor, RANKL, VEGF, glial derived growth factor, transforming growth factor-alpha or beta, lysosomal acid alpha-glucosidase, alpha-galactosidase A, tumor necrosis growth factor soluble receptor, S100A1, parvalbumin, adenylyl cyclase type 6, SERCA2A, Inhibitor 1 of PP 1 or fragments thereof, truncated constitutively active bARKct, IRAP, anti-myostatin protein, aspartoacylase, trastuzumab, galanin, Neuropeptide Y, Vasohibin 2, thymidine kinase, cytosine deaminase, diphtheria toxin, tumor necrosis factor, p53, Rb, Wt-1, TRAIL, RS1, opsin, TKR-beta, C3, CFH, and/or FAS-ligand.
39. The recombinant AAV viral vector of embodiment 36 or 37, wherein the cargo nucleic acid encodes a gene-editing molecule.
40. The recombinant AAV viral vector of embodiment 39, wherein the gene-editing molecule is a nuclease.
41. The recombinant AAV viral vector of embodiment 39 or 40, wherein the gene-editing molecule is a Cas9 nuclease.
42. The recombinant AAV viral vector of embodiment 39 or 40, wherein the gene-editing molecule is a Cpf1 nuclease.
43. The recombinant AAV viral vector of embodiment 39, wherein the gene-editing molecule is a guide RNA.
44. A pharmaceutical composition comprising the recombinant AAV viral vector of any one of embodiments 33 to 43.

45. The pharmaceutical composition of embodiment 44, wherein the composition further comprises a pharmaceutically acceptable carrier.
46. A method of treating a patient in need thereof comprising administering to the patient a therapeutically effective amount of a recombinant AAV viral vector of any one of embodiments 33 to 43 or the pharmaceutical composition of embodiment 44 or 45.
47. The method of embodiment 46, wherein the patient has a disease or disorder of the eye.
48. The method of embodiment 47, wherein the disease or disorder of the eye is retinitis pigmentosa, macular degeneration, optic neuritis, Leber's congenital amaurosis, Leber's hereditary optic neuropathy, achromatopsia, X-linked retinoschisis, optic neuritis, choroideremia, optic atrophy, retinal cone dystrophy, retinopathy, retinoblastoma, glaucoma, Bardet-Biedl syndrome, Usher syndrome, aniridia, Friedreich's ataxia, vitelliform macular dystrophy, retinoblastoma, Stargardt disease, Charcot-Marie-Tooth disease, Fuch's dystrophy, propionic acidemia, or color blindness.
49. The method of any one of embodiments 46-48, wherein the patient is a mammal.
50. The method of embodiment 49, wherein the patient is a human.
51. A method of introducing a nucleic acid molecule into a cell, comprising contacting the cell with the recombinant AAV viral vector of any one of embodiments 33 to 43.
52. An AAV viral vector of any one of embodiments 32-43 for use as a medicament.
53. An AAV viral vector of any one of embodiments 32-43 for use in a method of treatment.

EXAMPLES

Example 1. Combinatorial Engineering and Selection of AAV Vectors Targeting Ophthalmic Tissues The method for generating AAV mutants targeting ophthalmic tissues (i.e., the RPE and/or retina) is as follows. The first step involves identification of conformational 3D surface-exposed loop on the AAV capsid surface, for example using cryo-electron microscopy. Selected residues within the surface-exposed loop are then subjected to mutagenesis using degenerate primers with each codon substituted by nucleotides NNK and gene fragments combined together by Gibson assembly and/or multistep PCR. Capsid-encoding genes containing a degenerate library of mutated antigenic motifs are cloned into a wild type AAV genome to replace the original Cap encoding DNA sequence, yielding a plasmid library. Plasmid libraries are then transfected into 293 producer cell lines with an adenoviral helper plasmid to generate AAV capsid libraries, which can then be subjected to selection. Successful generation of AAV libraries is confirmed via DNA sequencing.

In order to select for new AAV strains that that have desirable transduction profiles, AAV libraries are subjected to multiple rounds of infection in non-human primates. At each stage, tissues of interest are isolated from animal subjects. Cell lysates harvested from the tissues of interest are sequenced to identify AAV vector isolates successfully transducing a target tissue of interest. After multiple rounds of infection in non-human primates, the isolated sequences from each mutagenized region are combined in all permutations and combinations.

Figure 2A:
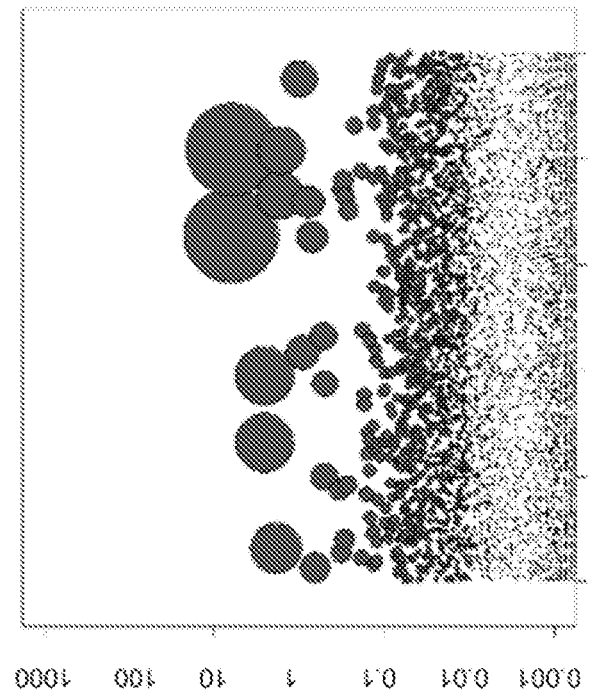
FIG. 2A and FIG. 2B. Bubble plots showing parental (FIG. 2A) and evolved (FIG. 2B) libraries for a first round of evolution.
Figure 2B:
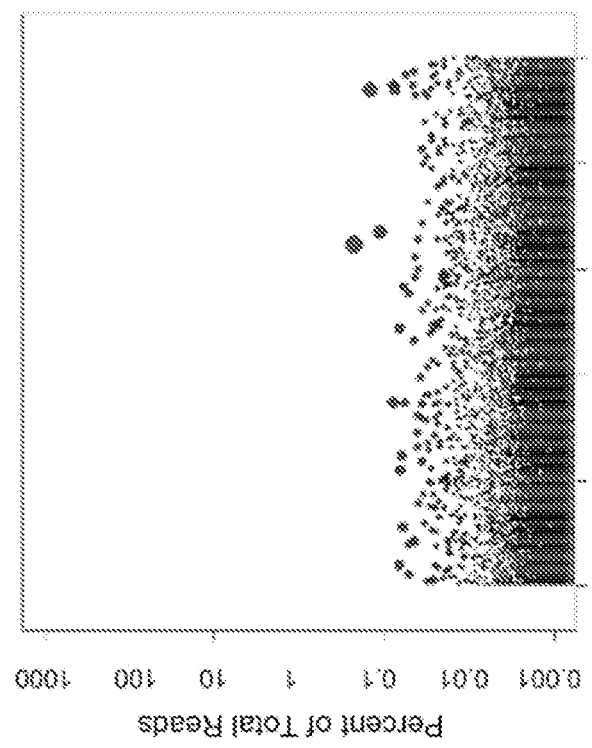

As a nonlimiting specific example, a surface-exposed loop on an AAV capsid protein was subjected to mutagenesis as described above to produce degenerate libraries of AAV vectors. The degenerate libraries were then subjected to a first round of infection in non-human primates (FIG. 1A, FIG. 2A). Specifically, the libraries were administered to the eye of the primates by intravitreal injection. Retinal pigment epithelium (RPE) was harvested at day 7 post-infection and sequenced to identify single AAV isolates (FIG. 1B, FIG. 2B).

Figures 3A, 3B:
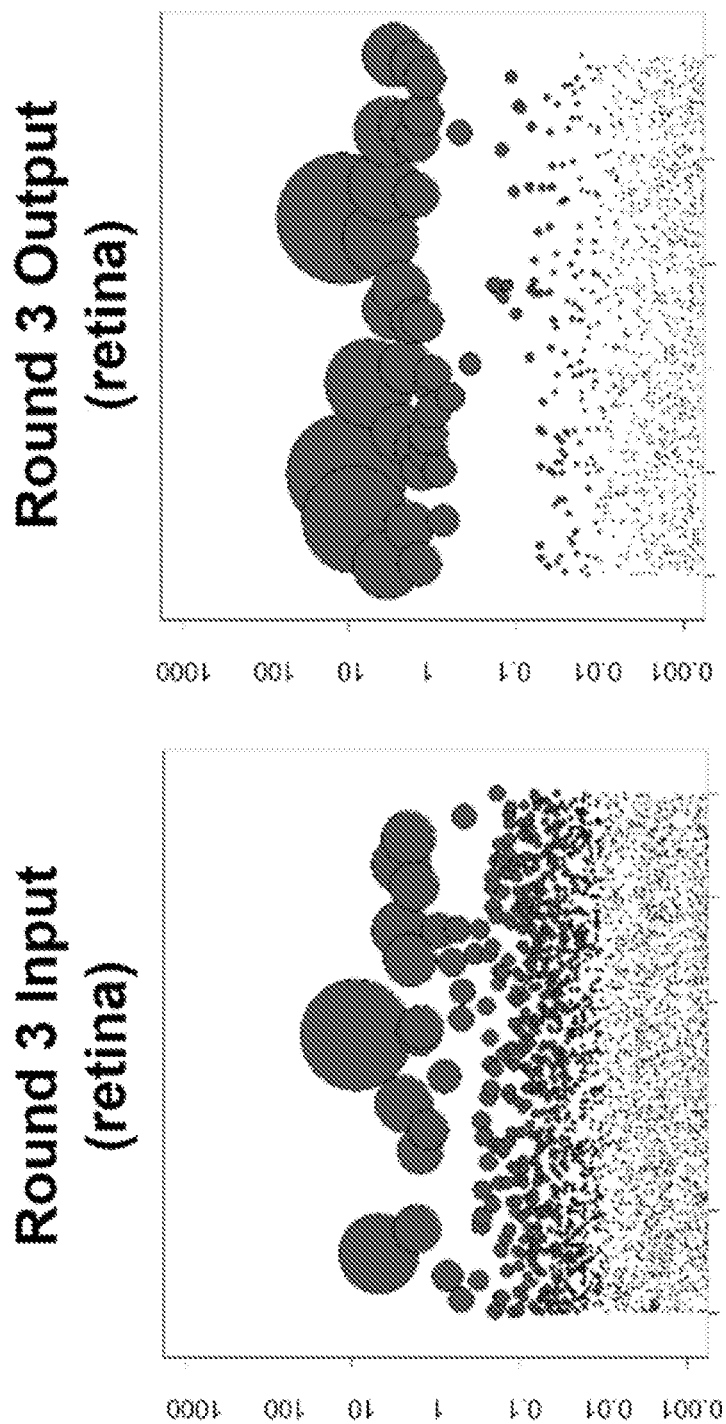
FIG. 3A and FIG. 3B. Bubble plots showing parental (FIG. 3A) and evolved (FIG. 3B) libraries for a third round of evolution performed in the retina, normalized to percent total reads.
Figure 4A:
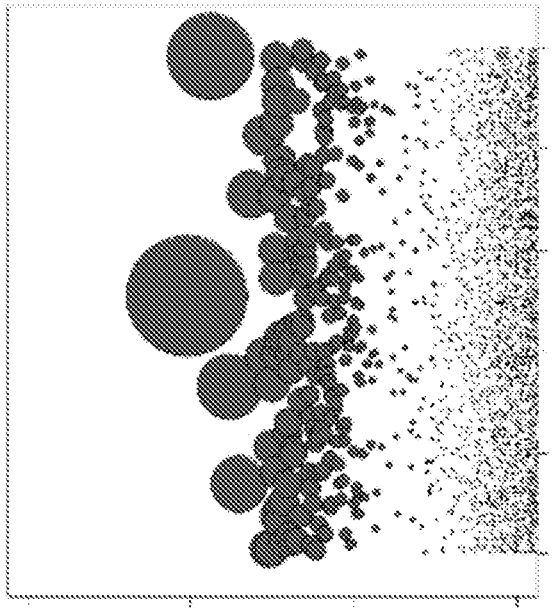
FIG. 4A and FIG. 4B. Bubble plots showing parental (FIG. 3A) and evolved (FIG. 3B) libraries for a third round of evolution performed in the RPE, normalized to percent total reads.

The AAVs isolated during the first round of evolution (FIG. 2B) were then reintroduced into a second non-human primate by intravitreal injection. Retinal pigment epithelium (RPE) (FIG. 3A) and retina (FIG. 4A) were harvested at day 7 post-infection and sequenced to identify single AAV isolates.

Figure 4B:
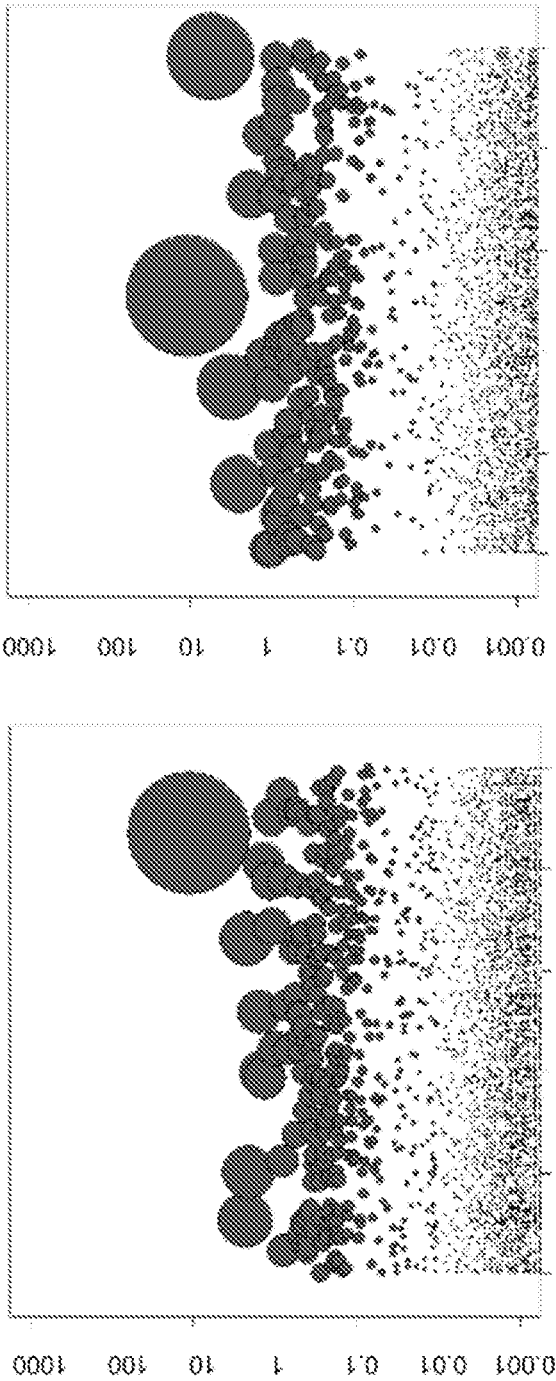

The AAVs isolated during the second round of evolution in RPE were reintroduced into a third non-human primate, and the AAVs isolated during the second round of evolution in retina were reintroduced into a fourth non-human primate by intravitreal injection. RPE was harvested at day 7 post-infection from the third primate (FIG. 3B), and retina was harvested at day 7 post-infection from the fourth primate (FIG. 4B), and sequenced to identify single AAV isolates.

A description of the various isolates identified in RPE and/or retina is provided in Table 7. These isolates specifically target and infect the RPE and/or the retina in vivo, in non-human primates.

TABLE 7

Surface loop substitutions in recombinant AAVs Isolated from RPE and/or retina

| Sequence Replacing Surface Loop Sequence | Full Capsid Sequence |
|---|---|
| KVRDLF (SEQ ID NO: 14) | SEQ ID NOs: 32, 41 |
| RVLALR (SEQ ID NO: 15) | SEQ ID NOs: 33, 42 |
| RVHALR (SEQ ID NO: 16) | SEQ ID NOs: 34, 43 |
| RVHSLR (SEQ ID NO: 17) | SEQ ID NOs: 35, 44 |
| GVGVLP (SEQ ID NO: 18) | SEQ ID NOs: 36, 45 |
| FVNALN (SEQ ID NO: 19) | SEQ ID NOs: 37, 46 |
| IVRSLN (SEQ ID NO: 20) | SEQ ID NOs: 38, 47 |
| HVLRLN (SEQ ID NO: 21) | SEQ ID NOs: 39, 48 |
| RVLALQ (SEQ ID NO: 22) | SEQ ID NOs: 40, 49 |
| RVRGLR (SEQ ID NO: 187) | SEQ ID NOs: 195, 203 |
| KVRTLR (SEQ ID NO: 188) | SEQ ID NOs: 196, 204 |
| MVGNLV (SEQ ID NO: 189) | SEQ ID NOs: 197, 205 |
| RVLGLR (SEQ ID NO: 190) | SEQ ID NOs: 198, 206 |
| KVAGLC (SEQ ID NO: 191) | SEQ ID NOs: 199, 207 |
| IVRPLV (SEQ ID NO: 192) | SEQ ID NOs: 200, 208 |
| KVRGLA (SEQ ID NO: 193) | SEQ ID NOs: 201, 209 |
| RVRGLG (SEQ ID NO: 194) | SEQ ID NOs: 202, 210 |

Example 2. Recombinant AAV Vectors Transduce Cells in Culture

To confirm whether various AAV vectors isolated from non-human primate RPE and/or retina in Example 1 are generally infective and able to transduce cells in culture, various AAV vectors packaging a luciferase transgene were prepared, wherein each AAV vector included a capsid sequence comprising one of the substitutions listed in Table 7. The AAV vectors were contacted with U87 cells (primary glioblastoma cell line) maintained under standard culture conditions. The cells were infected at a multiplicity of infection (MOI) of 10,000 vg/cell. 48 hours later, the cells were lysed, the lysate was contacted with a bioluminescent substrate, and RFUs were measured.

Figure 5:
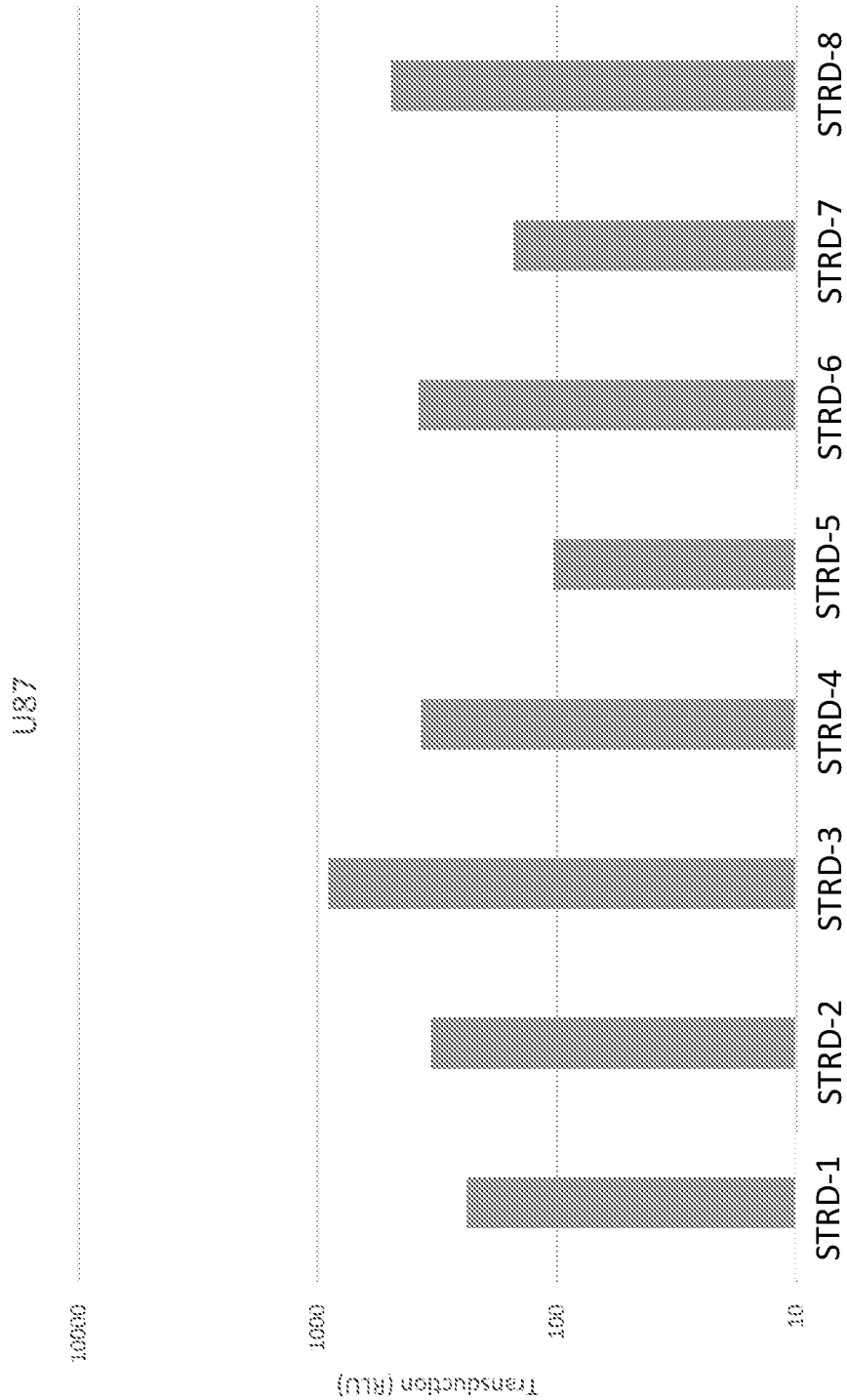
FIG. 5. Graph showing transduction of various AAV-luciferase vectors comprising mutant capsid proteins (STRD-1, SEQ ID NO: 34; STRD-2, SEQ ID NO: 32; STRD-3, SEQ ID NO: 36; STRD-4, SEQ ID NO: 195; STRD-5, SEQ ID NO: 35; STRD-6, SEQ ID NO: 196; STRD-7, SEQ ID NO: 37; and STRD-8, SEQ ID NO: 40) into U87 cells in culture. The cells were infected at a multiplicity of infection (MOI) of 10,000 vg/cell. Relative light units (RLUs) were measured 48 hours post-transduction.

As shown in FIG. 5, all AAV vectors tested were able to successfully transduce U87 cells in culture, resulting in expression of their packaged transgene (luciferase) in the cells. This data confirms that the recombinant AAV vectors are infective and can be used to deliver a transgene to a cell of interest.

The foregoing is illustrative of the present invention, and is not to be construed as limiting thereof. The invention is defined by the following claims, with equivalents of the claims to be included therein.

SEQUENCE LISTING (259 sequences)

SEQ ID NO: 1 - protein, 736 aa, Dependovirus adeno-associated virus 1
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 2 - protein, 735 aa, Dependovirus adeno-associated virus 2 [sequence omitted]

SEQ ID NO: 3 - protein, 736 aa, Dependovirus adeno-associated virus 3
MAADGYLPDWLEDNLSEGIREWWALKPGVPQPKANQQHQDNRRGLVLPGYKYLGPGNGLDKGEPVNEADAAALEHDKAYDQQLKAGDNPYLKYNHADAEFQERLQEDTSFGGNLGRAVFQAKKRILEPLGLVEEAAKTAPGKKRPVDQSPQEPDSSSGVGKSGKQPARKRLNFGQTGDSESVPDPQPLGEPPAAPTSLGSNTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKKLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNRTQGTTSGTTNQSRLLFSQAGPQSMSLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTAPTTRTVNDQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSVNVDFTVDTNGVYSEPRPIGTRYLTRNL

SEQ ID NO: 4 - protein, 734 aa, Dependovirus adeno-associated virus 4
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYKIPATGSDSLIKYETHSTLDGRWSALTPGPPMATAGPADSKFSNSQLIFAGPKQNGNTATVPGTLIFTSEEELAATNATDTDMWGNLPGGDQSNSNLPTVDRLTALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 5 - protein, 724 aa, Dependovirus adeno-associated virus 5
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 6 - protein, 736 aa, Dependovirus adeno-associated virus 6
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 7 - protein, 737 aa, Dependovirus adeno-associated virus 7
MAADGYLPDWLEDNLSEGIREWWDLKPGAPKPKANQQKQDNGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPAKKRPVEPSPQRSPDSSTGIGKKGQQPARKRLNFGQTGDSESVPDPQPLGEPPAAPSSVGSGTVAAGGGAPMADNNEGADGVGNASGNWHCDSTWLGDRVITTSTRTWALPTYNNHLYKQISSETAGSTNDNTYFGYSTPWGYFDFNRFHCHFSPRDWQRLINNNWGFRPKKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYSFEDVPFHSSYAHSQSLDRLMNPLIDQYLYYLARTQSNPGGTAGNRELQFYQGGPSTMAEQAKNWLPGPCFRQQRVSKTLDQNNNSNFAWTGATKYHLNGRNSLVNPGVAMATHKDDEDRFFPSSGVLIFGKTGATNKTTLENVLMTNEEEIRPTNPVATEEYGIVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFEKQTGVDFAVDSQGVYSEPRPIGTRYLTRNL

SEQ ID NO: 8 - protein, 738 aa, Dependovirus adeno-associated virus 8
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 9 - protein, 736 aa, Dependovirus adeno-associated virus 9
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 10 - protein, 738 aa, Dependovirus adeno-associated virus 10
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTDGTYSEPRPIGTRYLTRNL

SEQ ID NO: 11 - protein, 735 aa, Artificial sequence
  Recombinant AAV capsid
MAADGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYEIPATGSDSLIEYETHSTLDGRWSALTPGPPMATAGPADSKFSNSQLIFAGPKQNGNTATVPGTLIFTSEEELAATNATDTDMWGNLPGGDQSSSNLPTVDRLTALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 12 - protein, 734 aa, Artificial sequence
  Recombinant AAV capsid
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYEIPATGSDSLIEYETHSTLDGRWSALTPGPPMATAGPADSKFSNSQLIFAGPKQNGNTATVPGTLIFTSEEELAATNATDTDMWGNLPGGDQSSSNLPTVDRLTALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 13 - skipped

SEQ ID NO: 14 - protein, 6 aa, Artificial sequence
  AAV capsid amino acid substitution sequence
KVRDLF

SEQ ID NO: 15 - protein, 6 aa, Artificial sequence
  AAV capsid amino acid substitution sequence
RVLALR

SEQ ID NO: 16 - protein, 6 aa, Artificial sequence
  AAV capsid amino acid substitution sequence
RVHALR

SEQ ID NO: 17 - protein, 6 aa, Artificial sequence
  AAV capsid amino acid substitution sequence
RVHSLR

SEQ ID NO: 18 - protein, 6 aa, Artificial sequence
  AAV capsid amino acid substitution sequence
GVGVLP

SEQ ID NO: 19 - protein, 6 aa, Artificial sequence
  AAV capsid amino acid substitution sequence
FVNALN

SEQ ID NO: 20 - protein, 6 aa, Artificial sequence
  AAV capsid amino acid substitution sequence
IVRSLN

SEQ ID NO: 21 - protein, 6 aa, Artificial sequence
  AAV capsid amino acid substitution sequence
HVLRLN

SEQ ID NO: 22 - protein, 6 aa, Artificial sequence
  AAV capsid amino acid substitution sequence
RVLALQ

SEQ ID NO: 23 - protein, 734 aa, Artificial sequence
  Recombinant AAV capsid
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYKIPATGSDSLIKYETHSTLDGRWSALTPGPPMATAGPADSKFSNSQLIFAGPKQNGNTATVPGTLIFTSEEELAATNATDTDMWGNLPGGDQSNSNLPKVRDLFALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 24 - protein, 734 aa, Artificial sequence
  Recombinant AAV capsid
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYKIPATGSDSLIKYETHSTLDGRWSALTPGPPMATAGPADSKFSNSQLIFAGPKQNGNTATVPGTLIFTSEEELAATNATDTDMWGNLPGGDQSNSNLPRVLALRALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 25 - protein, 734 aa, Artificial sequence
  Recombinant AAV capsid
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYKIPATGSDSLIKYETHSTLDGRWSALTPGPPMATAGPADSKFSNSQLIFAGPKQNGNTATVPGTLIFTSEEELAATNATDTDMWGNLPGGDQSNSNLPRVHALRALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 26 - protein, 734 aa, Artificial sequence
  Recombinant AAV capsid
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYKIPATGSDSLIKYETHSTLDGRWSALTPGPPMATAGPADSKFSNSQLIFAGPKQNGNTATVPGTLIFTSEEELAATNATDTDMWGNLPGGDQSNSNLPRVHSLRALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 27 - protein, 734 aa, Artificial sequence
  Recombinant AAV capsid
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYKIPATGSDSLIKYETHSTLDGRWSALTPGPPMATAGPADSKFSNSQLIFAGPKQNGNTATVPGTLIFTSEEELAATNATDTDMWGNLPGGDQSNSNLPGVGVLPALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 28 - protein, 734 aa, Artificial sequence
  Recombinant AAV capsid
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYKIPATGSDSLIKYETHSTLDGRWSALTPGPPMATAGPADSKFSNSQLIFAGPKQNGNTATVPGTLIFTSEEELAATNATDTDMWGNLPGGDQSNSNLPFVNALNALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 29 - protein, 734 aa, Artificial sequence
  Recombinant AAV capsid
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYKIPATGSDSLIKYETHSTLDGRWSALTPGPPMATAGPADSKFSNSQLIFAGPKQNGNTATVPGTLIFTSEEELAATNATDTDMWGNLPGGDQSNSNLPIVRSLNALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 30 - protein, 734 aa, Artificial sequence
  Recombinant AAV capsid
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYKIPATGSDSLIKYETHSTLDGRWSALTPGPPMATAGPADSKFSNSQLIFAGPKQNGNTATVPGTLIFTSEEELAATNATDTDMWGNLPGGDQSNSNLPHVLRLNALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 31 - protein, 734 aa, Artificial sequence
  Recombinant AAV capsid
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYKIPATGSDSLIKYETHSTLDGRWSALTPGPPMATAGPADSKFSNSQLIFAGPKQNGNTATVPGTLIFTSEEELAATNATDTDMWGNLPGGDQSNSNLPRVLALQALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 32 - protein, 735 aa, Artificial sequence
  Recombinant AAV capsid
MAADGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYEIPATGSDSLIEYETHSTLDGRWSALTPGPPMATAGPADSKFSNSQLIFAGPKQNGNTATVPGTLIFTSEEELAATNATDTDMWGNLPGGDQSSSNLPKVRDLFALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 33 - protein, 735 aa, Artificial sequence
  Recombinant AAV capsid
MAADGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYEIPATGSDSLIEYETHSTLDGRWSALTPGPPMATAGPADSKFSNSQLIFAGPKQNGNTATVPGTLIFTSEEELAATNATDTDMWGNLPGGDQSSSNLPRVLALRALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 34 - protein, 735 aa, Artificial sequence
  Recombinant AAV capsid
MAADGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYEIPATGSDSLIEYETHSTLDGRWSALTPGPPMATAGPADSKFSNSQLIFAGPKQNGNTATVPGTLIFTSEEELAATNATDTDMWGNLPGGDQSSSNLPRVHALRALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 35 - protein, 735 aa, Artificial sequence
  Recombinant AAV capsid
MAADGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYEIPATGSDSLIEYETHSTLDGRWSALTPGPPMATAGPADSKFSNSQLIFAGPKQNGNTATVPGTLIFTSEEELAATNATDTDMWGNLPGGDQSSSNLPRVHSLRALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 36 - protein, 735 aa, Artificial sequence
  Recombinant AAV capsid
MAADGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYEIPATGSDSLIEYETHSTLDGRWSALTPGPPMATAGPADSKFSNSQLIFAGPKQNGNTATVPGTLIFTSEEELAATNATDTDMWGNLPGGDQSSSNLPGVGVLPALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 37 - protein, 735 aa, Artificial sequence
  Recombinant AAV capsid
MAADGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYEIPATGSDSLIEYETHSTLDGRWSALTPGPPMATAGPADSKFSNSQLIFAGPKQNGNTATVPGTLIFTSEEELAATNATDTDMWGNLPGGDQSSSNLPFVNALNALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 38 - protein, 735 aa, Artificial sequence
  Recombinant AAV capsid
MAADGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYEIPATGSDSLIEYETHSTLDGRWSALTPGPPMATAGPADSKFSNSQLIFAGPKQNGNTATVPGTLIFTSEEELAATNATDTDMWGNLPGGDQSSSNLPIVRSLNALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 39 - protein, 735 aa, Artificial sequence
  Recombinant AAV capsid
MAADGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYEIPATGSDSLIEYETHSTLDGRWSALTPGPPMATAGPADSKFSNSQLIFAGPKQNGNTATVPGTLIFTSEEELAATNATDTDMWGNLPGGDQSSSNLPHVLRLNALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 40 - protein, 735 aa, Artificial sequence
  Recombinant AAV capsid
MAADGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYEIPATGSDSLIEYETHSTLDGRWSALTPGPPMATAGPADSKFSNSQLIFAGPKQNGNTATVPGTLIFTSEEELAATNATDTDMWGNLPGGDQSSSNLPRVLALQALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 41 - protein, 734 aa, Artificial sequence
  Recombinant AAV capsid
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYEIPATGSDSLIEYETHSTLDGRWSALTPGPPMATAGPADSKFSNSQLIFAGPKQNGNTATVPGTLIFTSEEELAATNATDTDMWGNLPGGDQSSSNLPKVRDLFALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 42 - protein, 734 aa, Artificial sequence
  Recombinant AAV capsid
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYEIPATGSDSLIEYETHSTLDGRWSALTPGPPMATAGPADSKFSNSQLIFAGPKQNGNTATVPGTLIFTSEEELAATNATDTDMWGNLPGGDQSSSNLPRVLALRALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 43 - protein, 734 aa, Artificial sequence
  Recombinant AAV capsid
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYEIPATGSDSLIEYETHSTLDGRWSALTPGPPMATAGPADSKFSNSQLIFAGPKQNGNTATVPGTLIFTSEEELAATNATDTDMWGNLPGGDQSSSNLPRVHALRALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 44 - protein, 734 aa, Artificial sequence
  Recombinant AAV capsid
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYEIPATGSDSLIEYETHSTLDGRWSALTPGPPMATAGPADSKFSNSQLIFAGPKQNGNTATVPGTLIFTSEEELAATNATDTDMWGNLPGGDQSSSNLPRVHSLRALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 45 - protein, 734 aa, Artificial sequence
  Recombinant AAV capsid
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYEIPATGSDSLIEYETHSTLDGRWSALTPGPPMATAGPADSKFSNSQLIFAGPKQNGNTATVPGTLIFTSEEELAATNATDTDMWGNLPGGDQSSSNLPGVGVLPALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 46 - protein, 734 aa, Artificial sequence
  Recombinant AAV capsid
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYEIPATGSDSLIEYETHSTLDGRWSALTPGPPMATAGPADSKFSNSQLIFAGPKQNGNTATVPGTLIFTSEEELAATNATDTDMWGNLPGGDQSSSNLPFVNALNALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 47 - protein, 734 aa, Artificial sequence
  Recombinant AAV capsid
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYEIPATGSDSLIEYETHSTLDGRWSALTPGPPMATAGPADSKFSNSQLIFAGPKQNGNTATVPGTLIFTSEEELAATNATDTDMWGNLPGGDQSSSNLPIVRSLNALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 48 - protein, 734 aa, Artificial sequence
  Recombinant AAV capsid
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYEIPATGSDSLIEYETHSTLDGRWSALTPGPPMATAGPADSKFSNSQLIFAGPKQNGNTATVPGTLIFTSEEELAATNATDTDMWGNLPGGDQSSSNLPHVLRLNALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 49 - protein, 734 aa, Artificial sequence
  Recombinant AAV capsid
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYEIPATGSDSLIEYETHSTLDGRWSALTPGPPMATAGPADSKFSNSQLIFAGPKQNGNTATVPGTLIFTSEEELAATNATDTDMWGNLPGGDQSSSNLPRVLALQALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 50 - protein, 5 aa, Artificial sequence
  peptide sequence triggering uptake by liver cells
FVFLP

SEQ ID NO: 51 - protein, 4 aa, Artificial sequence
  heparin sulfate or heparin binding domain
  MISC_FEATURE (1)..(1): Xaa can be any basic amino acid
  MISC_FEATURE (2)..(3): Xaa can be any neutral and/or hydrophobic amino acid
  MISC_FEATURE (4)..(4): Xaa can be any basic amino acid
XXXX

SEQ ID NO: 52 - protein, 4 aa, Artificial sequence
  heparin sulfate or heparin binding domain
RGNR

SEQ ID NO: 53 - protein, 7 aa, Artificial sequence
  Targeting peptide sequence
  MISC_FEATURE (7)..(7): Xaa can be G or S
NSVRDLX

SEQ ID NO: 54 - protein, 7 aa, Artificial sequence
  Targeting peptide sequence
PRSVTVP

SEQ ID NO: 55 - protein, 7 aa, Artificial sequence
  Targeting peptide sequence
  MISC_FEATURE (6)..(6): Xaa can be any amino acid
  MISC_FEATURE (7)..(7): Xaa can be S or A
NSVSSXX

SEQ ID NO: 56 - protein, 6 aa, Artificial sequence
  Targeting peptide sequence
NGRAHA

SEQ ID NO: 57 - protein, 7 aa, Artificial sequence
  Targeting peptide sequence
QPEHSST

SEQ ID NO: 58 - protein, 7 aa, Artificial sequence
  Targeting peptide sequence
VNTANST

SEQ ID NO: 59 - protein, 6 aa, Artificial sequence
  Targeting peptide sequence
HGPMQS

SEQ ID NO: 60 - protein, 7 aa, Artificial sequence
  Targeting peptide sequence
PHKPPLA

SEQ ID NO: 61 - protein, 7 aa, Artificial sequence
  Targeting peptide sequence
IKNNEMW

SEQ ID NO: 62 - protein, 7 aa, Artificial sequence
  Targeting peptide sequence
RNLDTPM

SEQ ID NO: 63 - protein, 7 aa, Artificial sequence
  Targeting peptide sequence
VDSHRQS

SEQ ID NO: 64 - protein, 7 aa, Artificial sequence
  Targeting peptide sequence
YDSKTKT

SEQ ID NO: 65 - protein, 7 aa, Artificial sequence
  Targeting peptide sequence
SQLPHQK

SEQ ID NO: 66 - protein, 7 aa, Artificial sequence
  Targeting peptide sequence
STMQQNT

SEQ ID NO: 67 - protein, 7 aa, Artificial sequence
  Targeting peptide sequence
TERYMTQ

SEQ ID NO: 68 - protein, 7 aa, Artificial sequence
  Targeting peptide sequence
QPEHSST

SEQ ID NO: 69 - protein, 7 aa, Artificial sequence
  Targeting peptide sequence
DASLSTS

SEQ ID NO: 70 - protein, 6 aa, Artificial sequence
  Targeting peptide sequence
DLPNKT

SEQ ID NO: 71 - protein, 7 aa, Artificial sequence
  Targeting peptide sequence
DLTAARL

SEQ ID NO: 72 - protein, 7 aa, Artificial sequence
  Targeting peptide sequence
EPHQFNY

SEQ ID NO: 73 - protein, 7 aa, Artificial sequence
  Targeting peptide sequence
EPQSNHT

SEQ ID NO: 74 - protein, 7 aa, Artificial sequence
  Targeting peptide sequence
MSSWPSQ

SEQ ID NO: 75 - protein, 7 aa, Artificial sequence
  Targeting peptide sequence
NPKHNAT

SEQ ID NO: 76 - protein, 7 aa, Artificial sequence
  Targeting peptide sequence
PDGMRTT

SEQ ID NO: 77 - protein, 7 aa, Artificial sequence
  Targeting peptide sequence
PNNNKTT

SEQ ID NO: 78 - protein, 7 aa, Artificial sequence
  Targeting peptide sequence
QSTTHDS

SEQ ID NO: 79 - protein, 7 aa, Artificial sequence
  Targeting peptide sequence
TGSKQKQ

SEQ ID NO: 80 - protein, 7 aa, Artificial sequence
  Targeting peptide sequence
SLKHQAL

SEQ ID NO: 81 - protein, 7 aa, Artificial sequence
  Targeting peptide sequence
SPIDGEQ

SEQ ID NO: 82 - protein, 8 aa, Artificial sequence
  Targeting peptide sequence
WIFPWIQL

SEQ ID NO: 83 - protein, 9 aa, Artificial sequence
  Targeting peptide sequence
CDCRGDCFC

SEQ ID NO: 84 - protein, 5 aa, Artificial sequence
  Targeting peptide sequence
CNGRC

SEQ ID NO: 85 - protein, 7 aa, Artificial sequence
  Targeting peptide sequence
CPRECES

SEQ ID NO: 86 - protein, 10 aa, Artificial sequence
  Targeting peptide sequence
CTTHWGFTLC

SEQ ID NO: 87 - protein, 9 aa, Artificial sequence
  Targeting peptide sequence
CGRRAGGSC

SEQ ID NO: 88 - protein, 9 aa, Artificial sequence
  Targeting peptide sequence
CKGGRAKDC

SEQ ID NO: 89 - protein, 9 aa, Artificial sequence
  Targeting peptide sequence
CVPELGHEC

SEQ ID NO: 90 - protein, 9 aa, Artificial sequence
  Targeting peptide sequence
CRRETAWAK

SEQ ID NO: 91 - protein, 14 aa, Artificial sequence
  Targeting peptide sequence
VSWFSHRYSPFAVS

SEQ ID NO: 92 - protein, 13 aa, Artificial sequence
  Targeting peptide sequence
GYRDGYAGPILYN

SEQ ID NO: 93 - protein, 7 aa, Artificial sequence
  Targeting peptide sequence
  MISC_FEATURE: Xaa can be any amino acid
  misc_feature (1)..(3): Xaa can be any naturally occurring amino acid
  MOD_RES (4)..(4): Y is phosphotyrosine
  misc_feature (5)..(7): Xaa can be any naturally occurring amino acid
XXXYXXX

SEQ ID NO: 94 - protein, 4 aa, Artificial sequence
  Targeting peptide sequence
  MOD_RES (1)..(1): Y is phosphotyrosine
  MISC_FEATURE (2)..(2): Xaa can be E or M
YXNW

SEQ ID NO: 95 - protein, 7 aa, Artificial sequence
  Targeting peptide sequence
RPLPPLP

SEQ ID NO: 96 - protein, 7 aa, Artificial sequence
  Targeting peptide sequence
APPLPPR

SEQ ID NO: 97 - protein, 12 aa, Artificial sequence
  Targeting peptide sequence
DVFYPYPYASGS

SEQ ID NO: 98 - protein, 6 aa, Artificial sequence
  Targeting peptide sequence
MYWYPY

SEQ ID NO: 99 - protein, 12 aa, Artificial sequence
  Targeting peptide sequence
DITWDQLWDLMK

SEQ ID NO: 100 - protein, 8 aa, Artificial sequence
  Targeting peptide sequence
  MISC_FEATURE: Xaa can be G or L
  misc_feature (5)..(5): Xaa can be any naturally occurring amino acid
CWDDXWLC

SEQ ID NO: 101 - protein, 14 aa, Artificial sequence
  Targeting peptide sequence
EWCEYLGGYLRCYA

SEQ ID NO: 102 - protein, 14 aa, Artificial sequence
  Targeting peptide sequence
  MISC_FEATURE: Xaa can be any amino acid
  misc_feature (2)..(2): Xaa can be any naturally occurring amino acid
  misc_feature (4)..(5): Xaa can be any naturally occurring amino acid
  misc_feature (8)..(8): Xaa can be any naturally occurring amino acid
  misc_feature (11)..(11): Xaa can be any naturally occurring amino acid
  misc_feature (13)..(13): Xaa can be any naturally occurring amino acid
YXCXXGPXTWXCXP

SEQ ID NO: 103 - protein, 14 aa, Artificial sequence
  Targeting peptide sequence
IEGPTLRQWLAARA

SEQ ID NO: 104 - protein, 5 aa, Artificial sequence
  Targeting peptide sequence
  MISC_FEATURE (3)..(4): Xaa can be any amino acid
  MISC_FEATURE (5)..(5): Xaa can be Y, W, F, or H
LWXXX

SEQ ID NO: 105 - protein, 7 aa, Artificial sequence
  Targeting peptide sequence
  MISC_FEATURE: Xaa can be any amino acid
  misc_feature (1)..(1): Xaa can be any naturally occurring amino acid
  misc_feature (3)..(4): Xaa can be any naturally occurring amino acid
XFXXYLW

SEQ ID NO: 106 - protein, 6 aa, Artificial sequence
  Targeting peptide sequence
RWGLCD

SEQ ID NO: 107 - protein, 13 aa, Artificial sequence
  Targeting peptide sequence
MSRPACPPNDKYE

SEQ ID NO: 108 - protein, 8 aa, Artificial sequence
  Targeting peptide sequence
CLRSGRGC

SEQ ID NO: 109 - protein, 9 aa, Artificial sequence
  Targeting peptide sequence
CHWMFSPWC

SEQ ID NO: 110 - protein, 4 aa, Artificial sequence
  Targeting peptide sequence
  MISC_FEATURE: Xaa can be any amino acid
  misc_feature (2)..(3): Xaa can be any naturally occurring amino acid
WXXF

SEQ ID NO: 111 - protein, 8 aa, Artificial sequence
  Targeting peptide sequence
CSSRLDAC

SEQ ID NO: 112 - protein, 7 aa, Artificial sequence
  Targeting peptide sequence
CLPVASC

SEQ ID NO: 113 - protein, 13 aa, Artificial sequence
  Targeting peptide sequence
CGFECVRQCPERC

SEQ ID NO: 114 - protein, 13 aa, Artificial sequence
  Targeting peptide sequence
CVALCREACGEGC

SEQ ID NO: 115 - protein, 9 aa, Artificial sequence
  Targeting peptide sequence
SWCEPGWCR

SEQ ID NO: 116 - protein, 6 aa, Artificial sequence
  Targeting peptide sequence
YSGWGW

SEQ ID NO: 117 - protein, 7 aa, Artificial sequence
  Targeting peptide sequence
GLSGGRS

SEQ ID NO: 118 - protein, 7 aa, Artificial sequence
  Targeting peptide sequence
LMLPRAD

SEQ ID NO: 119 - protein, 9 aa, Artificial sequence
  Targeting peptide sequence
CSCFRDVCC

SEQ ID NO: 120 - protein, 9 aa, Artificial sequence
  Targeting peptide sequence
CRDVVSVIC

SEQ ID NO: 121 - protein, 5 aa, Artificial sequence
  Targeting peptide sequence
CNGRC

SEQ ID NO: 122 - protein, 6 aa, Artificial sequence
  Targeting peptide sequence
MARSGL

SEQ ID NO: 123 - protein, 6 aa, Artificial sequence
  Targeting peptide sequence
MARAKE

SEQ ID NO: 124 - protein, 6 aa, Artificial sequence
  Targeting peptide sequence
MSRTMS

SEQ ID NO: 125 - protein, 6 aa, Artificial sequence
  Targeting peptide sequence
KCCYSL

SEQ ID NO: 126 - protein, 14 aa, Artificial sequence
  Targeting peptide sequence
MYWGDSHWLQYWYE

SEQ ID NO: 127 - protein, 7 aa, Artificial sequence
  Targeting peptide sequence
MQLPLAT

SEQ ID NO: 128 - protein, 4 aa, Artificial sequence
  Targeting peptide sequence
EWLS

SEQ ID NO: 129 - protein, 4 aa, Artificial sequence
  Targeting peptide sequence
SNEW

SEQ ID NO: 130 - protein, 4 aa, Artificial sequence
  Targeting peptide sequence
TNYL

SEQ ID NO: 131 - protein, 8 aa, Artificial sequence
  Targeting peptide sequence
WIFPWIQL

SEQ ID NO: 132 - protein, 12 aa, Artificial sequence
  Targeting peptide sequence
WDLAWMFRLPVG

SEQ ID NO: 133 - protein, 13 aa, Artificial sequence
  Targeting peptide sequence
CTVALPGGYVRVC

SEQ ID NO: 134 - protein, 9 aa, Artificial sequence
  Targeting peptide sequence
CVPELGHEC

SEQ ID NO: 135 - protein, 9 aa, Artificial sequence
  Targeting peptide sequence
CGRRAGGSC

SEQ ID NO: 136 - protein, 13 aa, Artificial sequence
  Targeting peptide sequence
CVAYCIEHHCWTC

SEQ ID NO: 137 - protein, 12 aa, Artificial sequence
  Targeting peptide sequence
CVFAHNYDYLVC

SEQ ID NO: 138 - protein, 10 aa, Artificial sequence
  Targeting peptide sequence
CVFTSNYAFC

SEQ ID NO: 139 - protein, 7 aa, Artificial sequence
  Targeting peptide sequence
VHSPNKK

SEQ ID NO: 140 - protein, 9 aa, Artificial sequence
  Targeting peptide sequence
CDCRGDCFC

SEQ ID NO: 141 - protein, 7 aa, Artificial sequence
  Targeting peptide sequence
CRGDGWC

SEQ ID NO: 142 - protein, 6 aa, Artificial sequence
  Targeting peptide sequence
  MISC_FEATURE: Xaa can be any amino acid
  misc_feature (1)..(1): Xaa can be any naturally occurring amino acid
  misc_feature (6)..(6): Xaa can be any naturally occurring amino acid
XRGCDX

SEQ ID NO: 143 - protein, 4 aa, Artificial sequence
  Targeting peptide sequence
  MISC_FEATURE (2)..(3): Xaa can be any amino acid
  MISC_FEATURE (4)..(4): Xaa can be S or T
PXXX

SEQ ID NO: 144 - protein, 10 aa, Artificial sequence
  Targeting peptide sequence
CTTHWGFTLC

SEQ ID NO: 145 - protein, 11 aa, Artificial sequence
  Targeting peptide sequence
SGKGPRQITAL

SEQ ID NO: 146 - protein, 6 aa, Artificial sequence
  Targeting peptide sequence
  MISC_FEATURE (2)..(2): Xaa can be A or Q
  MISC_FEATURE (3)..(3): Xaa can be N or A
  MISC_FEATURE (4)..(4): Xaa can be L or Y
  MISC_FEATURE (5)..(5): Xaa can be T, V, M , or R
  MISC_FEATURE (6)..(6): Xaa can be R or K
AXXXXX

SEQ ID NO: 147 - protein, 6 aa, Artificial sequence
  Targeting peptide sequence
VYMSPF

SEQ ID NO: 148 - protein, 7 aa, Artificial sequence
  Targeting peptide sequence
MQLPLAT

SEQ ID NO: 149 - protein, 7 aa, Artificial sequence
  Targeting peptide sequence
ATWLPPR

SEQ ID NO: 150 - protein, 12 aa, Artificial sequence
  Targeting peptide sequence
HTMYYHHYQHHL

SEQ ID NO: 151 - protein, 19 aa, Artificial sequence
  Targeting peptide sequence
SEVGCRAGPLQWLCEKYFG

SEQ ID NO: 152 - protein, 18 aa, Artificial sequence
  Targeting peptide sequence
CGLLPVGRPDRNVWRWLC

SEQ ID NO: 153 - protein, 15 aa, Artificial sequence
  Targeting peptide sequence
CKGQCDRFKGLPWEC

SEQ ID NO: 154 - protein, 5 aa, Artificial sequence
  Targeting peptide sequence
SGRSA

SEQ ID NO: 155 - protein, 4 aa, Artificial sequence
  Targeting peptide sequence
WGFP

SEQ ID NO: 156 - protein, 6 aa, Artificial sequence
  Targeting peptide sequence
  MISC_FEATURE: Xaa can be any amino acid
  misc_feature (3)..(4): Xaa can be any naturally occurring amino acid
LWXXAR

SEQ ID NO: 157 - protein, 7 aa, Artificial sequence
  Targeting peptide sequence
  MISC_FEATURE: Xaa can be any amino acid
  misc_feature (1)..(1): Xaa can be any naturally occurring amino acid
  misc_feature (3)..(4): Xaa can be any naturally occurring amino acid
XFXXYLW

SEQ ID NO: 158 - protein, 17 aa, Artificial sequence
  Targeting peptide sequence
AEPMPHSLNFSQYLWYT

SEQ ID NO: 159 - protein, 6 aa, Artificial sequence
  Targeting peptide sequence
  MISC_FEATURE: Xaa can be W or F
  misc_feature (4)..(4): Xaa can be any naturally occurring amino acid
WAYXSP

SEQ ID NO: 160 - protein, 7 aa, Artificial sequence
  Targeting peptide sequence
IELLQAR

SEQ ID NO: 161 - protein, 12 aa, Artificial sequence
  Targeting peptide sequence
DITWDQLWDLMK

SEQ ID NO: 162 - protein, 16 aa, Artificial sequence
  Targeting peptide sequence
AYTKCSRQWRTCMTTH

SEQ ID NO: 163 - protein, 15 aa, Artificial sequence
  Targeting peptide sequence
PQNSKIPGPTFLDPH

SEQ ID NO: 164 - protein, 15 aa, Artificial sequence
  Targeting peptide sequence
SMEPALPDWWWKMFK

SEQ ID NO: 165 - protein, 16 aa, Artificial sequence
  Targeting peptide sequence
ANTPCGPYTHDCPVKR

SEQ ID NO: 166 - protein, 12 aa, Artificial sequence
  Targeting peptide sequence
TACHQHVRMVRP

SEQ ID NO: 167 - protein, 12 aa, Artificial sequence
  Targeting peptide sequence
VPWMEPAYQRFL

SEQ ID NO: 168 - protein, 8 aa, Artificial sequence
  Targeting peptide sequence
DPRATPGS

SEQ ID NO: 169 - protein, 12 aa, Artificial sequence
  Targeting peptide sequence
FRPNRAQDYNTN

SEQ ID NO: 170 - protein, 9 aa, Artificial sequence
  Targeting peptide sequence
CTKNSYLMC

SEQ ID NO: 171 - protein, 11 aa, Artificial sequence
  Targeting peptide sequence
  MISC_FEATURE (2)..(2): Xaa can be R or Q
  MISC_FEATURE (3)..(3): Xaa can be L or R
  MISC_FEATURE (5)..(5): Xaa can be G or N
  MISC_FEATURE (6)..(7): Xaa can be any amino acid
  MISC_FEATURE (8)..(8): Xaa can be A or V
  misc_feature (9)..(9): Xaa can be any naturally occurring amino acid
CXXTXXXGXGC

SEQ ID NO: 172 - protein, 9 aa, Artificial sequence
  Targeting peptide sequence
CPIEDRPMC

SEQ ID NO: 173 - protein, 12 aa, Artificial sequence
  Targeting peptide sequence
HEWSYLAPYPWF

SEQ ID NO: 174 - protein, 9 aa, Artificial sequence
  Targeting peptide sequence
MCPKHPLGC

SEQ ID NO: 175 - protein, 15 aa, Artificial sequence
  Targeting peptide sequence
RMWPSSTVNLSAGRR

SEQ ID NO: 176 - protein, 20 aa, Artificial sequence
  Targeting peptide sequence
SAKTAVSQRVWLPSHRGGEP

SEQ ID NO: 177 - protein, 20 aa, Artificial sequence
  Targeting peptide sequence
KSREHVNNSACPSKRITAAL

SEQ ID NO: 178 - protein, 4 aa, Artificial sequence
  Targeting peptide sequence
EGFR

SEQ ID NO: 179 - protein, 6 aa, Artificial sequence
  Targeting peptide sequence
AGLGVR

SEQ ID NO: 180 - protein, 15 aa, Artificial sequence
  Targeting peptide sequence
GTRQGHTMRLGVSDG

SEQ ID NO: 181 - protein, 15 aa, Artificial sequence
  Targeting peptide sequence
IAGLATPGWSHWLAL

SEQ ID NO: 182 - protein, 7 aa, Artificial sequence
  Targeting peptide sequence
SMSIARL

SEQ ID NO: 183 - protein, 7 aa, Artificial sequence
  Targeting peptide sequence
HTFEPGV

SEQ ID NO: 184 - protein, 15 aa, Artificial sequence
  Targeting peptide sequence
NTSLKRISNKRIRRK

SEQ ID NO: 185 - protein, 15 aa, Artificial sequence
  Targeting peptide sequence
LRIKRKRRKRKKTRK

SEQ ID NO: 186 - protein, 6 aa, Artificial sequence
  AAV capsid amino acid substitution sequence
  MISC_FEATURE (1)..(1): Xaa can be any amino acid
  MISC_FEATURE (2)..(2): Xaa is V
  MISC_FEATURE (3)..(4): Xaa can be any amino acid
  MISC_FEATURE (5)..(5): Xaa is L
  MISC_FEATURE (6)..(6): Xaa can be any amino acid
XXXXXX

SEQ ID NO: 187 - protein, 6 aa, Artificial sequence
  AAV capsid amino acid substitution sequence
RVRGLR

SEQ ID NO: 188 - protein, 6 aa, Artificial sequence
  AAV capsid amino acid substitution sequence
KVRTLR

SEQ ID NO: 189 - protein, 6 aa, Artificial sequence
  AAV capsid amino acid substitution sequence
MVGNLV

SEQ ID NO: 190 - protein, 6 aa, Artificial sequence
  AAV capsid amino acid substitution sequence
RVLGLR

SEQ ID NO: 191 - protein, 6 aa, Artificial sequence
  AAV capsid amino acid substitution sequence
KVAGLC

SEQ ID NO: 192 - protein, 6 aa, Artificial sequence
  AAV capsid amino acid substitution sequence
IVRPLV

SEQ ID NO: 193 - protein, 6 aa, Artificial sequence
  AAV capsid amino acid substitution sequence
KVRGLA

SEQ ID NO: 194 - protein, 6 aa, Artificial sequence
  AAV capsid amino acid substitution sequence
RVRGLG

SEQ ID NO: 195 - protein, 735 aa, Artificial sequence
  Recombinant AAV capsid
MAADGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYEIPATGSDSLIEYETHSTLDGRWSALTPGPPMATAGPADSKFSNSQLIFAGPKQNGNTATVPGTLIFTSEEELAATNATDTDMWGNLPGGDQSSSNLPRVRGLRALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 196 - protein, 735 aa, Artificial sequence
  Recombinant AAV capsid
MAADGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYEIPATGSDSLIEYETHSTLDGRWSALTPGPPMATAGPADSKFSNSQLIFAGPKQNGNTATVPGTLIFTSEEELAATNATDTDMWGNLPGGDQSSSNLPKVRTLRALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 197 - protein, 735 aa, Artificial sequence
  Recombinant AAV capsid
MAADGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYEIPATGSDSLIEYETHSTLDGRWSALTPGPPMATAGPADSKFSNSQLIFAGPKQNGNTATVPGTLIFTSEEELAATNATDTDMWGNLPGGDQSSSNLPMVGNLVALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 198 - protein, 735 aa, Artificial sequence
  Recombinant AAV capsid
MAADGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYEIPATGSDSLIEYETHSTLDGRWSALTPGPPMATAGPADSKFSNSQLIFAGPKQNGNTATVPGTLIFTSEEELAATNATDTDMWGNLPGGDQSSSNLPRVLGLRALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 199 - protein, 735 aa, Artificial sequence
  Recombinant AAV capsid
MAADGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYEIPATGSDSLIEYETHSTLDGRWSALTPGPPMATAGPADSKFSNSQLIFAGPKQNGNTATVPGTLIFTSEEELAATNATDTDMWGNLPGGDQSSSNLPKVAGLCALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 200 - protein, 735 aa, Artificial sequence
  Recombinant AAV capsid
MAADGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYEIPATGSDSLIEYETHSTLDGRWSALTPGPPMATAGPADSKFSNSQLIFAGPKQNGNTATVPGTLIFTSEEELAATNATDTDMWGNLPGGDQSSSNLPIVRPLVALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 201 - protein, 735 aa, Artificial sequence
  Recombinant AAV capsid
MAADGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYEIPATGSDSLIEYETHSTLDGRWSALTPGPPMATAGPADSKFSNSQLIFAGPKQNGNTATVPGTLIFTSEEELAATNATDTDMWGNLPGGDQSSSNLPKVRGLAALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 202 - protein, 735 aa, Artificial sequence
  Recombinant AAV capsid
MAADGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYEIPATGSDSLIEYETHSTLDGRWSALTPGPPMATAGPADSKFSNSQLIFAGPKQNGNTATVPGTLIFTSEEELAATNATDTDMWGNLPGGDQSSSNLPRVRGLGALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 203 - protein, 734 aa, Artificial sequence
  Recombinant AAV capsid
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYEIPATGSDSLIEYETHSTLDGRWSALTPGPPMATAGPADSKFSNSQLIFAGPKQNGNTATVPGTLIFTSEEELAATNATDTDMWGNLPGGDQSSSNLPRVRGLRALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 204 - protein, 734 aa, Artificial sequence
  Recombinant AAV capsid
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYEIPATGSDSLIEYETHSTLDGRWSALTPGPPMATAGPADSKFSNSQLIFAGPKQNGNTATVPGTLIFTSEEELAATNATDTDMWGNLPGGDQSSSNLPKVRTLRALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 205 - protein, 734 aa, Artificial sequence
  Recombinant AAV capsid
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYEIPATGSDSLIEYETHSTLDGRWSALTPGPPMATAGPADSKFSNSQLIFAGPKQNGNTATVPGTLIFTSEEELAATNATDTDMWGNLPGGDQSSSNLPMVGNLVALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 206 - protein, 734 aa, Artificial sequence
  Recombinant AAV capsid
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYEIPATGSDSLIEYETHSTLDGRWSALTPGPPMATAGPADSKFSNSQLIFAGPKQNGNTATVPGTLIFTSEEELAATNATDTDMWGNLPGGDQSSSNLPRVLGLRALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 207 - protein, 734 aa, Artificial sequence
  Recombinant AAV capsid
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYEIPATGSDSLIEYETHSTLDGRWSALTPGPPMATAGPADSKFSNSQLIFAGPKQNGNTATVPGTLIFTSEEELAATNATDTDMWGNLPGGDQSSSNLPKVAGLCALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 208 - protein, 734 aa, Artificial sequence
  Recombinant AAV capsid
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYEIPATGSDSLIEYETHSTLDGRWSALTPGPPMATAGPADSKFSNSQLIFAGPKQNGNTATVPGTLIFTSEEELAATNATDTDMWGNLPGGDQSSSNLPIVRPLVALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 209 - protein, 734 aa, Artificial sequence
  Recombinant AAV capsid
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYEIPATGSDSLIEYETHSTLDGRWSALTPGPPMATAGPADSKFSNSQLIFAGPKQNGNTATVPGTLIFTSEEELAATNATDTDMWGNLPGGDQSSSNLPKVRGLAALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 210 - protein, 734 aa, Artificial sequence
  Recombinant AAV capsid
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYEIPATGSDSLIEYETHSTLDGRWSALTPGPPMATAGPADSKFSNSQLIFAGPKQNGNTATVPGTLIFTSEEELAATNATDTDMWGNLPGGDQSSSNLPRVRGLGALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 211 - protein, 734 aa, Artificial sequence
  Recombinant AAV capsid
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYKIPATGSDSLIKYETHSTLDGRWSALTPGPPMATAGPADSKFSNSQLIFAGPKQNGNTATVPGTLIFTSEEELAATNATDTDMWGNLPGGDQSNSNLPRVRGLRALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 212 - protein, 734 aa, Artificial sequence
  Recombinant AAV capsid
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYKIPATGSDSLIKYETHSTLDGRWSALTPGPPMATAGPADSKFSNSQLIFAGPKQNGNTATVPGTLIFTSEEELAATNATDTDMWGNLPGGDQSNSNLPKVRTLRALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 213 - protein, 734 aa, Artificial sequence
  Recombinant AAV capsid
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYKIPATGSDSLIKYETHSTLDGRWSALTPGPPMATAGPADSKFSNSQLIFAGPKQNGNTATVPGTLIFTSEEELAATNATDTDMWGNLPGGDQSNSNLPMVGNLVALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 214 - protein, 734 aa, Artificial sequence
  Recombinant AAV capsid
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYKIPATGSDSLIKYETHSTLDGRWSALTPGPPMATAGPADSKFSNSQLIFAGPKQNGNTATVPGTLIFTSEEELAATNATDTDMWGNLPGGDQSNSNLPRVLGLRALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 215 - protein, 734 aa, Artificial sequence
  Recombinant AAV capsid
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYKIPATGSDSLIKYETHSTLDGRWSALTPGPPMATAGPADSKFSNSQLIFAGPKQNGNTATVPGTLIFTSEEELAATNATDTDMWGNLPGGDQSNSNLPKVAGLCALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 216 - protein, 734 aa, Artificial sequence
  Recombinant AAV capsid
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYKIPATGSDSLIKYETHSTLDGRWSALTPGPPMATAGPADSKFSNSQLIFAGPKQNGNTATVPGTLIFTSEEELAATNATDTDMWGNLPGGDQSNSNLPIVRPLVALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 217 - protein, 734 aa, Artificial sequence
  Recombinant AAV capsid
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYKIPATGSDSLIKYETHSTLDGRWSALTPGPPMATAGPADSKFSNSQLIFAGPKQNGNTATVPGTLIFTSEEELAATNATDTDMWGNLPGGDQSNSNLPKVRGLAALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 218 - protein, 734 aa, Artificial sequence
  Recombinant AAV capsid
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYKIPATGSDSLIKYETHSTLDGRWSALTPGPPMATAGPADSKFSNSQLIFAGPKQNGNTATVPGTLIFTSEEELAATNATDTDMWGNLPGGDQSNSNLPRVRGLGALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 219 - protein, 735 aa, Artificial sequence; identical to SEQ ID NO: 32
  Recombinant AAV capsid

SEQ ID NO: 220 - protein, 735 aa, Artificial sequence; identical to SEQ ID NO: 32
  Recombinant AAV capsid

SEQ ID NO: 221 - protein, 735 aa, Artificial sequence; identical to SEQ ID NO: 35
  Recombinant AAV capsid

SEQ ID NO: 222 - protein, 735 aa, Artificial sequence; identical to SEQ ID NO: 35
  Recombinant AAV capsid

SEQ ID NO: 223 - protein, 735 aa, Artificial sequence; identical to SEQ ID NO: 37
  Recombinant AAV capsid

SEQ ID NO: 224 - protein, 735 aa, Artificial sequence; identical to SEQ ID NO: 37
  Recombinant AAV capsid

SEQ ID NO: 225 - protein, 735 aa, Artificial sequence; identical to SEQ ID NO: 40
  Recombinant AAV capsid

SEQ ID NO: 226 - protein, 735 aa, Artificial sequence; identical to SEQ ID NO: 40
  Recombinant AAV capsid

SEQ ID NO: 227 - protein, 734 aa, Artificial sequence; identical to SEQ ID NO: 42
  Recombinant AAV capsid

SEQ ID NO: 228 - protein, 735 aa, Artificial sequence; identical to SEQ ID NO: 33
  Recombinant AAV capsid

SEQ ID NO: 229 - protein, 734 aa, Artificial sequence; identical to SEQ ID NO: 43
  Recombinant AAV capsid

SEQ ID NO: 230 - protein, 735 aa, Artificial sequence; identical to SEQ ID NO: 34
  Recombinant AAV capsid

SEQ ID NO: 231 - protein, 734 aa, Artificial sequence; identical to SEQ ID NO: 45
  Recombinant AAV capsid

SEQ ID NO: 232 - protein, 735 aa, Artificial sequence; identical to SEQ ID NO: 36
  Recombinant AAV capsid

SEQ ID NO: 233 - protein, 734 aa, Artificial sequence; identical to SEQ ID NO: 47
  Recombinant AAV capsid

SEQ ID NO: 234 - protein, 735 aa, Artificial sequence; identical to SEQ ID NO: 38
  Recombinant AAV capsid

SEQ ID NO: 235 - protein, 734 aa, Artificial sequence; identical to SEQ ID NO: 48
  Recombinant AAV capsid

SEQ ID NO: 236 - protein, 735 aa, Artificial sequence; identical to SEQ ID NO: 39
  Recombinant AAV capsid

SEQ ID NO: 237 - protein, 734 aa, Artificial sequence; identical to SEQ ID NO: 203
  Recombinant AAV capsid

SEQ ID NO: 238 - protein, 735 aa, Artificial sequence; identical to SEQ ID NO: 195
  Recombinant AAV capsid

SEQ ID NO: 239 - protein, 734 aa, Artificial sequence; identical to SEQ ID NO: 204
  Recombinant AAV capsid

SEQ ID NO: 240 - protein, 735 aa, Artificial sequence; identical to SEQ ID NO: 196
  Recombinant AAV capsid

SEQ ID NO: 241 - protein, 734 aa, Artificial sequence; identical to SEQ ID NO: 205
  Recombinant AAV capsid

SEQ ID NO: 242 - protein, 735 aa, Artificial sequence; identical to SEQ ID NO: 197
  Recombinant AAV capsid

SEQ ID NO: 243 - protein, 734 aa, Artificial sequence; identical to SEQ ID NO: 206
  Recombinant AAV capsid

SEQ ID NO: 244 - protein, 735 aa, Artificial sequence; identical to SEQ ID NO: 198
  Recombinant AAV capsid

SEQ ID NO: 245 - protein, 734 aa, Artificial sequence; identical to SEQ ID NO: 207
  Recombinant AAV capsid

SEQ ID NO: 246 - protein, 735 aa, Artificial sequence; identical to SEQ ID NO: 199
  Recombinant AAV capsid

SEQ ID NO: 247 - protein, 734 aa, Artificial sequence; identical to SEQ ID NO: 208
  Recombinant AAV capsid

SEQ ID NO: 248 - protein, 735 aa, Artificial sequence; identical to SEQ ID NO: 200
  Recombinant AAV capsid

SEQ ID NO: 249 - protein, 734 aa, Artificial sequence; identical to SEQ ID NO: 209
  Recombinant AAV capsid

SEQ ID NO: 250 - protein, 735 aa, Artificial sequence; identical to SEQ ID NO: 201
  Recombinant AAV capsid

SEQ ID NO: 251 - protein, 734 aa, Artificial sequence; identical to SEQ ID NO: 210
  Recombinant AAV capsid

SEQ ID NO: 252 - protein, 735 aa, Artificial sequence; identical to SEQ ID NO: 202
  Recombinant AAV capsid

SEQ ID NO: 253 - protein, 734 aa, Artificial sequence; identical to SEQ ID NO: 12
  Recombinant AAV capsid

SEQ ID NO: 254 - protein, 735 aa, Artificial sequence; identical to SEQ ID NO: 11
  Recombinant AAV capsid

SEQ ID NO: 255 - protein, 6 aa, Artificial Sequence
  AAV capsid amino acid substitution sequence
  MISC_FEATURE (1)..(1): Xaa can be any amino acid except T
  MISC_FEATURE (2)..(2): Xaa can be any amino acid
  MISC_FEATURE (3)..(3): Xaa can be any amino acid except D
  MISC_FEATURE (4)..(4): Xaa can be any amino acid except R
  MISC_FEATURE (5)..(5): Xaa can be any amino acid
  MISC_FEATURE (6)..(6): Xaa can be any amino acid except T
XXXXXX

SEQ ID NO: 256 - protein, 6 aa, Artificial Sequence
  AAV capsid amino acid substitution sequence
  MISC_FEATURE (1)..(1): Xaa is K, G, F, I, H, or R
  MISC_FEATURE (2)..(6): Xaa can be any amino acid
XXXXXX

SEQ ID NO: 257 - protein, 6 aa, Artificial Sequence
  AAV capsid amino acid substitution sequence
  MISC_FEATURE (1)..(2): Xaa can be any amino acid
  MISC_FEATURE (3)..(3): Xaa is R, L, H, G, or N
  MISC_FEATURE (4)..(6): Xaa can be any amino acid
XXXXXX

SEQ ID NO: 258 - protein, 6 aa, Artificial Sequence
  AAV capsid amino acid substitution sequence
  MISC_FEATURE (1)..(3): Xaa can be any amino acid
  MISC_FEATURE (4)..(4): Xaa can be D, A, S, V, or R
  MISC_FEATURE (5)..(6): Xaa can be any amino acid
XXXXXX

SEQ ID NO: 259 - protein, 6 aa, Artificial Sequence
  AAV capsid amino acid substitution sequence
  MISC_FEATURE (1)..(5): Xaa can be any amino acid
  MISC_FEATURE (6)..(6): Xaa is F, R, P, N, or Q
XXXXXX

The invention claimed is:

1. A recombinant adeno-associated virus (AAV) capsid protein, wherein the capsid protein comprises a substitution that replaces the amino acids in the region corresponding to amino acid positions 591-596 of SEQ ID NO. 11 or amino acids 590-595 of SEQ ID NO. 12, wherein the substitution is a sequence of six amino acids ($X^1$-V-$X^3$-$X^4$-L-$X^6$; SEQ ID NO: 186), wherein:
   i. $X^1$ is K, G, F, or R;
   ii. $X^3$ is R, L, H, G, or N;
   iii. $X^4$ is D, A, S, V, G, or T; and
   iv. $X^6$ is F, R, P, N, or Q, and
   wherein the AAV capsid protein has an amino acid sequence with at least 90% identity to the amino acid sequence of SEQ ID NO: 11 or 12.

2. The recombinant AAV capsid protein of claim 1, wherein the substitution has the sequence of any one of SEQ ID NOs: 14, 16-19, 22, 187 and 188.

3. The recombinant AAV capsid protein of claim 1, wherein the capsid protein comprises an amino acid sequence that has at least 90% sequence identity with any one of SEQ ID NOs: 32, 34-37, 40, 195 and 196.

4. The recombinant AAV capsid protein of claim 3, wherein the capsid protein comprises the amino acid sequence of any one of SEQ ID NOs: 32, 34-37, 40, 195 and 196.

5. An adeno-associated virus (AAV) vector, comprising the recombinant AAV capsid protein of claim 4, and a cargo nucleic acid encapsidated by the AAV capsid protein.

6. The AAV vector of claim 5, wherein the cargo nucleic acid comprises a 5' inverted terminal repeat (5' ITR), a heterologous nucleic acid sequence encoding a therapeutic protein or RNA, and a 3' ITR.

7. A polynucleotide comprising a nucleotide sequence encoding the recombinant AAV capsid protein of claim 4.

8. An adeno-associated virus (AAV) vector, comprising the recombinant AAV capsid protein of claim 1, and a cargo nucleic acid encapsidated by the AAV capsid protein.

9. The AAV vector of claim 8, wherein the cargo nucleic acid encodes a therapeutic protein or RNA.

10. The AAV vector of claim 8, wherein the cargo nucleic acid comprises a 5' inverted terminal repeat (5' ITR), a heterologous nucleic acid sequence encoding a therapeutic protein or RNA, and a 3' ITR.

11. The AAV vector of claim 8, wherein the AAV vector has an enhanced transduction profile with respect to a target tissue, as compared to an AAV viral vector comprising a capsid protein that does not comprise the substitution.

12. The AAV vector of claim 11, wherein the target tissue is ophthalmic tissue.

13. The AAV vector of claim 8, wherein the cargo nucleic acid encodes one or more of the following proteins or an antibody that binds thereto: cystic fibrosis transmembrane regulator protein (CFTR), dystrophin, myostatin propeptide, follistatin, activin type 11 soluble receptor, IGF-I, Ikappa B dominant mutant, sarcospan, utrophin, mini-utrophin, Factor VIII, Factor IX, Factor X, erythropoietin, angiostatin, endostatin, catalase, tyrosine hydroxylase, superoxide dismutase, leptin, the LDL receptor, lipoprotein lipase, ornithine transcarbamylase, β-globin, α-globin, spectrin, alpha-1-antitrypsin, adenosine deaminase, hypoxanthine guanine phosphoribosyl transferase, β-glucocerebrosidase, sphingomyelinase, lysosomal hexosaminidase A, branched-chain keto acid dehydrogenase, RPE65 protein, alpha-interferon, beta-interferon, gamma-interferon, interleukin-2, interleukin-4, granulocyte-macrophage colony stimulating factor, lymphotoxin, a peptide growth factor, a neurotrophic factor, somatotropin, insulin, insulin-like growth factors 1 or 2, platelet derived growth factor, epidermal growth factor, fibroblast growth factor, nerve growth factor, neurotrophic factor-3 or -4, brain-derived neurotrophic factor, RANKL, VEGF, glial derived growth factor, transforming growth factor-alpha or beta, lysosomal acid alpha-glucosidase, alpha-galactosidase A, tumor necrosis growth factor soluble receptor, S100A1, parvalbumin, adenylyl cyclase type 6, SERCA2A, Inhibitor 1 of PP 1 or fragments thereof, truncated constitutively active bARKct, IRAP, anti-myostatin protein, aspartoacylase, trastuzumab, galanin, Neuropeptide Y, Vasohibin 2, thymidine kinase, cytosine deaminase, diphtheria toxin, tumor necrosis factor, p53, Rb, Wt-1, TRAIL, RS1, opsin, TKR-beta, C3, CFH, and/or FAS-ligand.

14. The AAV vector of claim 8, wherein the cargo nucleic acid encodes a gene editing molecule.

15. The AAV vector of claim 14, wherein the gene editing molecule is a nuclease or a guide RNA.

16. The AAV vector of claim 14, wherein, the gene editing molecule is a Cas9 nuclease or Cpf1 nuclease.

17. A method of introducing a cargo nucleic acid molecule into a cell, comprising contacting the cell with the AAV vector of claim 8.

18. A pharmaceutical composition, comprising the AAV vector of claim 8, and a pharmaceutically acceptable carrier.

19. A polynucleotide comprising a nucleotide sequence encoding the recombinant AAV capsid protein of claim 1.

20. An expression vector, comprising the polynucleotide of claim 19.

21. A cell, comprising the polynucleotide of claim 19.

* * * * *